US008871999B2

(12) United States Patent
Howe et al.

(10) Patent No.: US 8,871,999 B2
(45) Date of Patent: Oct. 28, 2014

(54) PROTECTION AGAINST HERBIVORES

(75) Inventors: Gregg A. Howe, East Lansing, MI (US); Hui Chen, Pullman, WA (US)

(73) Assignee: Board of Trustees of Michigan State University, East Lansing, MI (US)

( * ) Notice: Subject to any disclaimer, the term of this patent is extended or adjusted under 35 U.S.C. 154(b) by 2019 days.

(21) Appl. No.: 11/666,714

(22) PCT Filed: Oct. 31, 2005

(86) PCT No.: PCT/US2005/039363
§ 371 (c)(1),
(2), (4) Date: Sep. 4, 2008

(87) PCT Pub. No.: WO2006/050313
PCT Pub. Date: May 11, 2006

(65) Prior Publication Data
US 2009/0031457 A1    Jan. 29, 2009

Related U.S. Application Data

(60) Provisional application No. 60/623,462, filed on Oct. 29, 2004, provisional application No. 60/700,652, filed on Jul. 19, 2005.

(51) Int. Cl.
| A01H 1/00 | (2006.01) |
| C12N 15/00 | (2006.01) |
| C12N 15/29 | (2006.01) |
| C12N 15/52 | (2006.01) |
| C12N 9/78 | (2006.01) |
| C12N 15/82 | (2006.01) |
| C12N 9/88 | (2006.01) |
| C07H 21/04 | (2006.01) |
| C07K 14/415 | (2006.01) |

(52) U.S. Cl.
CPC .............. *C12N 15/8286* (2013.01); *C12N 9/78* (2013.01); *C12N 15/8251* (2013.01); *C12N 9/88* (2013.01)
USPC ........... 800/295; 435/6.1; 435/69.1; 435/468; 435/183; 435/419; 435/320.1; 536/23.2; 536/23.6; 800/278

(58) Field of Classification Search
USPC .............. 435/6.1, 69.1, 468, 183, 419, 320.1; 536/23.2, 23.6; 800/278, 295
See application file for complete search history.

(56) References Cited

U.S. PATENT DOCUMENTS

| 2003/0115639 A1 * | 6/2003 | Gorlach et al. ............... 800/288 |
| 2003/0138822 A1 * | 7/2003 | Glenn et al. ....................... 435/6 |
| 2003/0215428 A1 * | 11/2003 | Filbin et al. ................. 424/93.21 |

FOREIGN PATENT DOCUMENTS

| EP | 1033405 A2 | 9/2000 |
| WO | WO-9855601 A2 | 12/1998 |
| WO | WO-9941395 A1 | 8/1999 |
| WO | WO-0210218 A1 | 2/2002 |
| WO | WO-0222675 A2 | 3/2002 |
| WO | WO-03000898 A1 | 1/2003 |

OTHER PUBLICATIONS

"*Arabidopsis thaliana* arginase mRNA complete cds.", retrieved from EBI accession No. EM PRO: U15019 Database accession No. U15019, (Dec. 22, 1994).
"*Arabidopsis thaliana* AT4g08900/T3H13_7 mRNA, complete cds.", retrieved from EBI accession No. EM PRO:AY061914 Database accession No. AY061914, (Nov. 20, 2001).
"International Application Serial No. PCT/US2005/039363, International Preliminary Report on Patentability mailed May 1, 2007", 12 pgs.
"International Application Serial No. PCT/US2005/039363, International Search Report mailed Oct. 27, 2006", 6 pgs.
"International Application Serial No. PCT/US2005/039363, Written Opinion mailed Oct. 27, 2006", 11 pgs.
"*Lycopersicon esculentum* arginase 2 (ARG2) mRNA, complete cds.", retrieved from EBI accession No. EM PRO:AY656838 Database accession No. AY656838, (Oct. 31, 2004).
Chen, Hui, et al., "Regulation of plant arginase by wounding, jasmonate, and the phytotoxin coronatine.", JBC Papers in Press, [Online]. Retrieved from the Internet: <http://www.jbc.org/content/early/2004/08/20/jbc.M407151200.full.pdf+html>, (Aug. 20, 2004).
Chen, Hui, et al., "Regulation of plant arginase by wounding, jasmonate, and the phytotoxin coronatine.", Journal of Biological Chemistry vol. 279, No. 44, (Oct. 29, 2004), 45998-46007.
Chen, Hui, et al., "Regulation of tomato arginase by wounding, jasmonate, and the phytotoxin coronatine.", ASPB Meeting 2804, American Society of Plant Biologists, [Online] Retrieved from Internet: <http://abstracts.aspb.org/pb2004/public/P42/7178.html>, (Jul. 24, 2004).
Krumpelman, Paulette M, et al., "Nucleotide sequence of *Arabidopsis thaliana* arginase expressed in yeast.", Plant Physiology (Rockville) vol. 107, No. 4, (1995), 1479-1480.
Todd, Christopher D, et al., "Regulation of loblolly pine (*Pinus taeda* L.) arginase in developing seedling tissue during germination and post-germinative growth.", Plant Molecular Biology, vol. 45, No. 5, (Mar. 2001), 555-565.
"Canadian Application Serial No. 2,586,048, Office Action mailed Oct. 15, 2012", 2 pgs.
"Canadian Application Serial No. 2,586,048, Response filed Mar. 25, 2013 to Office Action dated Oct. 15, 2012", 7 pgs.

* cited by examiner

*Primary Examiner* — Phuong Bui
(74) *Attorney, Agent, or Firm* — Schwegman Lundberg & Woessner, P.A.

(57) ABSTRACT

The present invention relates to genes, proteins and methods comprising molecules that alter amino acid levels. In one embodiment, the present invention relates to altering guanidino substrate hydrolysis activities in plants, arthropods and microorganisms using molecules within the arginase family and other molecules that alter an amino acid levels. In ones embodiment, the present invention relates to altering threonine substrate deamination and dehydration activities in plants, arthropods and microorganisms using molecules within the threonine deaminase family and other molecules that alter amino acid levels. In one embodiment, the present invention relates to using genes, proteins and methods comprising arginase or threonine deaminase for altering the pathophysiology of plants, arthropods and microorganisms. In a preferred embodiment, the present invention relates to altering guanidino substrate hydrolysis activity in plants, arthropods, and microorganisms using arginase. In another preferred embodiment, the invention relates to altering threonine substrated deamination and dehydration activity in plants, arthropods, and microorganisms using threonine deaminase. In some embodiments, the invention related to overexpression and increased activity of arginase, threonine deaminase and a proteinase inhibitor.

11 Claims, 34 Drawing Sheets

| | | | |
|---|---|---|---|
| SEQ ID NO. 194 | | Synechocystis 2 | 167:LILGGDHSIGFPTVRGICRNLGDK...KVGIIHFDRHVDTQETDLDERM.HTCP..........NTH |
| SEQ ID NO. 195 | | E. coli | 119:LSFGGDHFVTLPLLRAHAKHFG.K...MALVHFDAHTDTYANG.C..EFDHGTM.........FYT |
| SEQ ID NO. 196 | | Arthrobacter | 125:VTLGDHTIALPLLRAAAERAG.E...PIAMLHFDAHIDTNDTYFGAE.YTHGTP.........FRR |
| SEQ ID NO. 197 | AG | Human 3 | 155:LTLGGDHTITYPIIQAMAKKHG.....PVGLLHVDAHTDTIDKALGEKLY.HGAP..........FRR |
| SEQ ID NO. 198 | | P. aeruginosa 1 | 122:LTLGGDHTITLPILRAIKKKHG.....KVGLVHVDAHADVNDHMFGEKIA.HGTT..........FRR |
| SEQ ID NO. 199 | | P. aeruginosa 2 | 119:LSVGGDHLVTLPIFRALGRER......PLGMVHFDAHSDTNDRYFGDNPYTHGTP.........FRR |
| SEQ ID NO. 200 | | Barley | 153:LVLGGDHSISYPVVRAVSEKLGG....PVDILHLDAHPDIYDCFEGNT.YSHASS..........FAR |
| SEQ ID NO. 201 | | Rice | 152:LVLGGDHSISYPVVRAVSEKLGG....PVDILHLDAHPDIYDAFEGNI.YSHASS..........FAR |
| SEQ ID NO. 202 | | Arabidopsis 1 | 154:LVLGGDHSISYPVVRAVSEKLGG....PVDILHLDAHPDIYDCFEGNK.YSHASS..........FAR |
| SEQ ID NO. 203 | | Tomato 1 | 150:LVLGGDHSISTPVVRAVSEKLGG....PIDILHLDAHPDIYHAFEGNK.YSHASS..........FAR |
| SEQ ID NO. 204 | PA | Tomato 2 | 150:LVLGGDHSISTPVVRAVSEKLGG....PVDILHLDAHPDIYDAFEGNK.YSHASS..........FAR |
| SEQ ID NO. 205 | | Soybean 1 | 162:LILGGDHSISTPVVRALSEKLGG....PVDVLHFDAHPDLYDEFEG.NYYSHASS...........FAR |
| SEQ ID NO. 206 | | Soybean 2 | 150:LVLGGDHSISTPVTRAVSEKLGG....PVDVLHLDAHPDNYDAFEG.NIYSHASS...........FAR |
| SEQ ID NO. 207 | | Arabidopsis 2 | 154:LVIGGDHSISTPVTRAVSEKLGG....PVDILHLDAHPDIYDRFEGNY.YSHASS..........FAR |
| SEQ ID NO. 208 | | Pine | 150:LVLGGDHSISTPVVRAVTDHLGG....PVDILHLDAHPDIYDAFEGNK.YSHASS..........FAR |
| SEQ ID NO. 209 | | A. tumefaciens 1 | 110:IFTLGEDHAISAGTVAGMARRV.AETGRPFFVLMLDAHTDYHTLETTRSGNLHGTPVAYFSGR....DGFSGYT. |
| SEQ ID NO. 210 | | N. crassa | 138:LTLGGDHSIAIGTIAGSAKAIKERLGREIAVIWVDAHADINTPETSGSGNIHGMPVSFLTGLASEDKE..EFFGW |
| SEQ ID NO. 211 | | B. subtilis 1 | 90:LVLGEDHSIAIGTLAG.....TAKHYDNLGVIWYDAHGDLNTLETSPSGNIHGMPLAVSLGIGHESIVNLEGIA. |
| SEQ ID NO. 212 | NA | B. caldevelox | 92:LVLGGDHSIAIGTLAG.....VAKHYERLGVIWYDAHGDVNTAETSPSGNIHGMPLAASLGFGHPALTQIGGYS. |
| SEQ ID NO. 213 | | Human 2 | 113:VTLGGDHSLAIGTIISG......HARHCPDLCVVWDAHADINTPLTTSSGNLHGQPVSELLRE.QDKVPQLPGFSW |
| SEQ ID NO. 214 | | Human 1 | 94:LVLGGDHSLAIGSISG......HARVHEDLGVIWVDAHTDINTPLTTTSGNLHGQPVSFLLKE.KGRIPDVPGFSW |

*Fig. 2A*

| | | |
|---|---|---|
| SEQ ID NO. 194 | | Synechocystis 2 | 220:ATMANAPAKNLVQLGIGGWQVPRQGVKCRERATNILTVTDITEMSLDAAADEALARA..T.DGTDCVVLSFDI |
| SEQ ID NO. 195 | | E. coli | 169:APREGLIDPNHSVQIGIRTEF........DKD.NGFTVLDACQVNDRSVDDVIAQV..KQ.I.VGDMPVVLTFDI |
| SEQ ID NO. 196 | | Arthrobacter | 178:AVEEGLLDIEAISHVGTRGPLYGKKDLDDDHRFGEIVTSADVYYQGVLETVAKI.RD.R.IGNRPLYISVDI |
| SEQ ID NO. 197 | AG | Human 3 | 207:CVDEGLLDCKRVVQIGIRGSSTTLDPYRYNRSQGERVVLAEDCWMKSIVPLMGEV..RQ.Q.MGGRFIYISFDI |
| SEQ ID NO. 198 | | P. aeruginosa 1 | 174:AVEEDLLDCDRVVQLGIRAQGTTAEDFNWSRKQGFRVVQAEECWHKSLEPLMAEV..RE.K.VGGGPVVLSFDI |
| SEQ ID NO. 199 | | P. aeruginosa 2 | 171:AIEEGLLDPLRFVQIGIRGSYYSPDDDAPARECGIRVIHMEEFVELGVEATLAEA..RR.V.VGDGPTYVSFDV |
| SEQ ID NO. 200 | | Barley | 206:IMEGGY..ARRLLQVGLRSITKEFREQGKRFGVEQYEMRTFSRDREKLENL......KL..G.EGVKGVYISVDV |
| SEQ ID NO. 201 | | Rice | 205:IMEGGY..ARRLLQVGIRSITKEFREQGKRFGVEQYEMRTFSKDREKLESL......KL..G.EGVKGVYISVDV |
| SEQ ID NO. 202 | | Arabidopsis 1 | 207:IMEGGY..ARRLLQVGIRSINQEFREQGKRFGVEQYEMRTFSQDRQFLENL......KL..G.EGVKGVYISVDV |
| SEQ ID NO. 203 | | Tomato 1 | 203:IMEGGY..ARRLLQVGIRSINLEFREQGKRFGVEQYEMRTFSRDRQFLENL......KL..G.EGVKGVYISIDV |
| SEQ ID NO. 204 | PA | Tomato 2 | 215:IMEGGY..ARRLLQVGIRSINKEFREQAKKFGVEQYEMRHFSKDRFFLENL......NL..G.EGAKGVYISIDV |
| SEQ ID NO. 205 | | Soybean 1 | 203:VMEGGY..VRRLLQVGIRSITAFGRAQAKKFGVEQYEMRTFSRDRPFLENL......KL..G.EGVKGVYISIDV |
| SEQ ID NO. 206 | | Soybean 2 | 209:IMEGGY..ARRLLQVGIRSINKEFREQGKRFGVEQYEMRTFSKDRQMLENL......KL..G.EGVKGVYISIDV |
| SEQ ID NO. 207 | | Arabidopsis 2 | 203:IMEGGH..ARRLLQVGIRSITKEFREQGKRFGVEQYEMHSFSKDRFLENL......KL..G.EGVKGVYISIDV |
| SEQ ID NO. 208 | | Pine | 178:PPLSHAVAEENIGMIGIRSVPEABRAALEKSGITVHDMR..SIDEHGVAVILREFLARVOAANGL...LHVSLDV |
| SEQ ID NO. 209 | | A. tumefaciens 1 | 211:LKPDHLLSVKKLVYIGLRDVDPGSKKRILRENGIKAFSMH..DIDKHGIGRVMEMALGHI...GNDTFIHLSFDV |
| SEQ ID NO. 210 | | N. crassa | 159:..P.KIKPENVVIGARSLDEGERKYIKESGMKVYTMH..EIDRLGMTKVIEETLDYL.SAC..D.GVHLSLDL |
| SEQ ID NO. 211 | | B. subtilis 1 | 161:..P.KIKEEHVVLLGVRSLIEGEKKFIREKGIKIYTMH..EVDRLGMTKVMEETLAYLKERT..D.GVHLSLDL |
| SEQ ID NO. 212 | NA | B. caldevelox | 183:IKP.CISSASIVYIGLRDYDPPEHFILRNYDIQYFSMR..DIDRLGIOKVMERTFDLLIGKR..QRFIHLSFDI |
| SEQ ID NO. 213 | | Human 2 | 164:VTP..CISAKDIVYIGLRDVDPGEHYIILKTLGIKYFSMT..EVDRLGICKVMEETLSYLLGRK..KRPIHLSFDV |
| SEQ ID NO. 214 | | Human 1 | | |

Fig. 2B

| | | | |
|---|---|---|---|
| SEQ ID NO. 194 | | Synechocystis 2 | 292:DCIDAGFVPGTGWPEPGGLLPREALYLLKRII.RETMVCGMEVVEVSPPYDIS.DM |
| SEQ ID NO. 195 | | E. coli | 231:DCLDPAFAPGTGTPVIGGLTSDRAIKLVRGL...KDLMIVGMDVVEVAPAYDQS.EI |
| SEQ ID NO. 196 | | Arthrobacter | 248:DVLDPAHAPGTGTPEAGGITSRELLEIIRGF..RGMMLVGADVVEVAPAYDHAE.I |
| SEQ ID NO. 197 | AG | Human 3 | 277:DALDPAYAPGTGTPEIAGLTPSQALEIIRGC..QGLNVMGCDLVEVSPPYDLSG.N |
| SEQ ID NO. 198 | | P. aeruginosa 1 | 244:DGIDRAWAPGTGTPEIGGLTIQAMEIIRGC..QGLDLIGCDLVEVSPPYDTTG.N |
| SEQ ID NO. 199 | | P. aeruginosa 2 | 241:DVLDPAFAPGTGTPEIGGMTSLQAQQLVRGL...RGLDLVGADVVEVSPFFDVGG.A |
| SEQ ID NO. 200 | | Barley | 270:DCLDPAFAPGVSHIEPGGLSFRDVLNILHNLQG....DVVAGDVVEFNPQRDTVDGM |
| SEQ ID NO. 201 | | Rice | 269:DCLDPAFAPGVSHIEPGGLSFRDVLNILHNLQG....DVVAGDVVEFNPQRDTVDGM |
| SEQ ID NO. 202 | | Arabidopsis 1 | 271:DCLDPAFAPGVSHIEPGGLSFRDVLNILHNLQA....DVVGADVVEFNPQRDTVDGM |
| SEQ ID NO. 203 | | Tomato 1 | 267:DCMDRAFAPGVSHIEPGGLSFRDVLNILHNLQA....DVVGADVVEFNPQRDTVDGM |
| SEQ ID NO. 204 | PA | Tomato 2 | 267:DCLDPAFAPGVSHFESGGLSFRDVLNILHNLQG....DIVGADVVEYNPQRDTADGM |
| SEQ ID NO. 205 | | Soybean 1 | 279:DCLDPGYAVEVSHYESGGLSFRDVMNMLQNLKG....DIVGGDVVEYNPQRDTPDRM |
| SEQ ID NO. 206 | | Soybean 2 | 267:DCLDPAFAPGVSHIEPGGLSFRDVLNILHNLQG....AVVAGDVVELNPQRDTDDGM |
| SEQ ID NO. 207 | | Arabidopsis 2 | 273:DCLDPFGAHGVSHFEPGGLSFRDVLNILHNLQG....DLVGADVVEYNPQRDTADDM |
| SEQ ID NO. 208 | | Pine | 267:DCLDPAFAPGVSHLEPGGLSFRGVMNLVQNLQG....DIVAADVVEFNPQRDTVDGM |
| SEQ ID NO. 209 | | A. tumefaciens 1 | 248:DFLEPSIADAVGTTVPGGATFREAHLVMEMLHDSGL.VCSLDLVELNPEL...... |
| SEQ ID NO. 210 | | N. crassa | 280:DALDRMWAPSTGTPVRGGLTLREGDFICECVHETGS.LVAVDLVEVNPTLAAPN.. |
| SEQ ID NO. 211 | | B. subtilis 1 | 225:DGLDPNDAPCVGTPVVGGISYRESHLAMEMLYDAGI.ITSAEFVEVNPIL..... |
| SEQ ID NO. 212 | NA | B. caldevelox | 228:DGLDPSDAPGVGTPVIGGLTYRESHLAMEMLAEAQI.ITSAEFVEVNPIL..... |
| SEQ ID NO. 213 | | Human 2 | 252:DAFTRPTLADATGTPVVGGLTYREGMYIAEEIHNTGL.LSAIDLVEVNPQLATSE. |
| SEQ ID NO. 214 | | Human 1 | 233:DGLDPSFTPATGTPVVGGLTYREGLYITEEIYKTGL.LSGLDLMEVNPSLGKTP.. |

*Fig. 2C*

Fig. 4
A
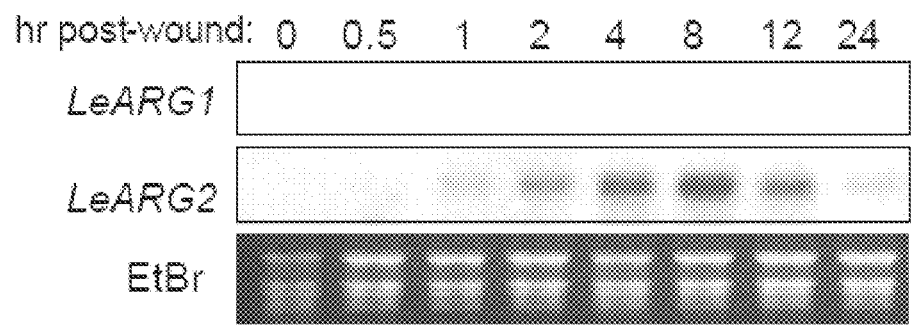
B
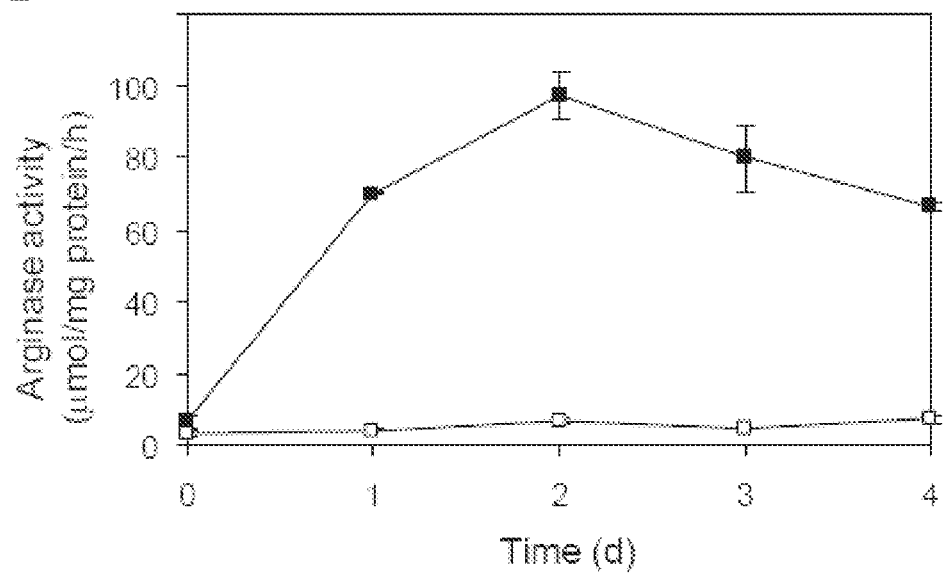

Fig. 5
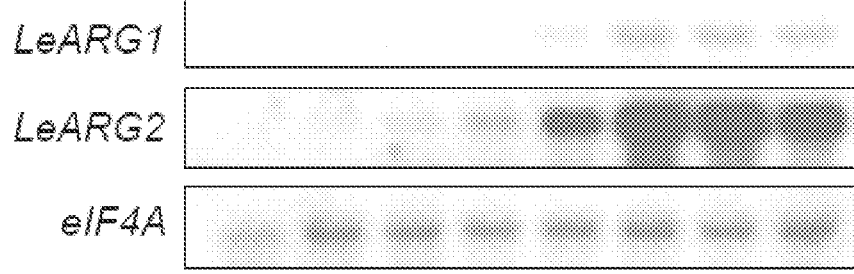
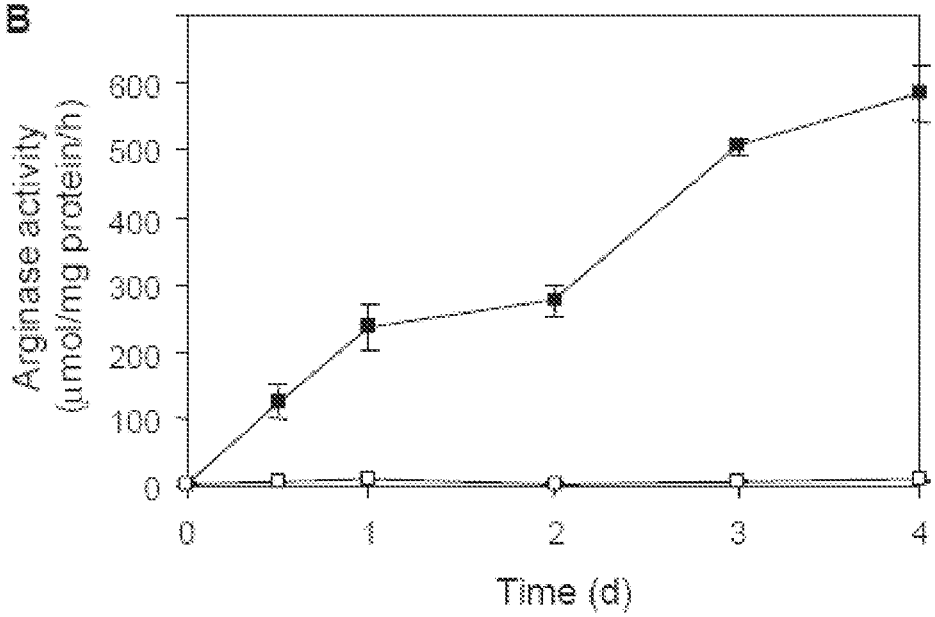

Fig. 8
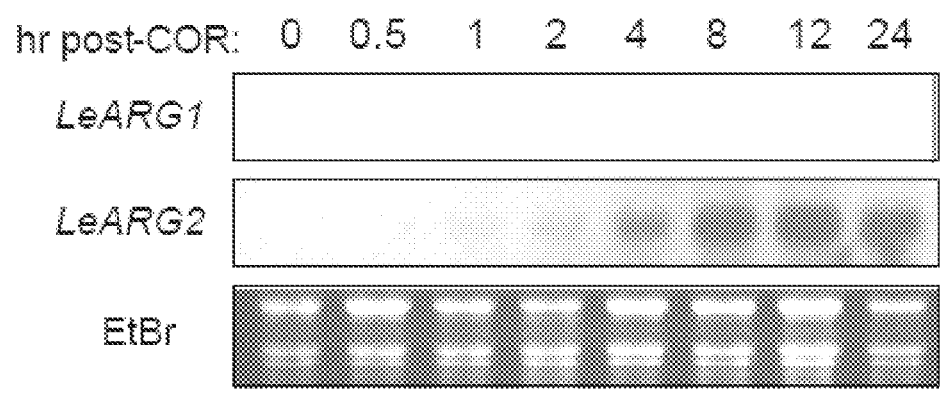
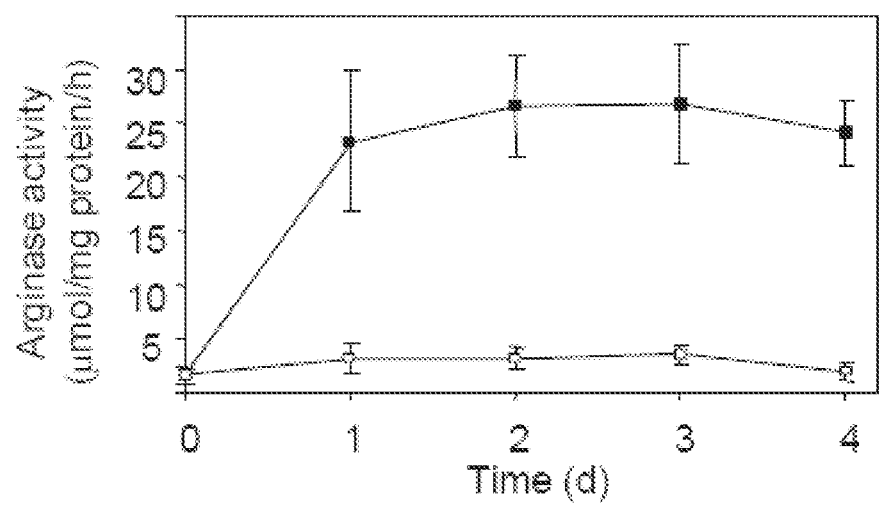

```
P_marinus
B_anthracis
B_cereus
B_subtilis_2
C_thermocellum
T_tengcongensis
M_jannaschii
M_fervidus
M_thermautotrophicus
S_tokodaii
S_solfataricus
A_pernix
M_barkeri
M_mazei
T_volcanium
P_abyssi
P_furiosus
A_fulgidus
synechococcus_WH8102_2    ISDVCNHNVDQKWR
Synechocystis_PCC6803_2   IHAEANMAVDEPWQ
V_vulnificus
V_cholerae
V_parahaemolyticus
E_coli
N_meningitidis
B_fungo_1
N_euopaea
P_fluorescens
S_coelicolor
S_avermitilis
T_fusca
Arthrobacter_KUJ8601      GYAQQALGARIQEVAQAIGGQR
human_3
Chicken
```

*Fig. 9/1*

```
P_putida          ------------------------------
P_aeruginosa_1    ------------------------------
B_fungo_2         ------------------------------
P_aeruginosa_2    ------------------------------
R_sphaeroides     ------------------------------
S_meliloti        ------------------------------
B_melitensis      VMDRPTISY---------------------
A_tumefaciens_1   VMDRPIRAG---------------------
A_tumefaciens_2   VFDRYTTAF---------------------
B_japonicum_      ITDRPTPSKAIAPGE---------------
L_mexicana        LLYTPHTSSKL-------------------
S_cerevisiae      LL----------------------------
N_crassa          VL----------------------------
S_pombe           LL----------------------------
B_subtilis_1      LL----------------------------
B_caldevelox      LM----------------------------
B_halodurans      LL----------------------------
B_brevis          LL----------------------------
Mouse_2           REGGHIVYDHLPTPSSPHESENEECVRI
Rat_2             REGGHIAYDHLPTPSSPHESEKEECVRI
Human_2           REGGHIVYDQLPTPSSFDESENQARVRI
Danio_2           REGAHVSFPKITEPKEDTELRL--------
Rat_1             REGNHKPET...DYLKPPK-----------
Mouse_1           REGNHKPGT...DYLKPPK-----------
Pig               REGNHKP.I...DYLKPPK-----------
Human_1           REGNHKP.I...DYLNPPK-----------
Xenopus           REGFHASTMMLPDIF---------------
Danio_1           REGSHDPDYKMPNP----------------
S_japonicum       RSGQLPMKVNRSTINTIVRQAERIQIK-
Drosophila        RSGRWSNIDTGILGSD--------------
P_yoelii          IV----------------------------
consensus         ..............................
```

Fig. 9I2

PROTECTION AGAINST HERBIVORES

This Application is a U.S. National Stage Filing Under 35 U.S.C. 371 of International Patent Application Serial No. PCT/US2005/039363, filed Oct. 31, 2005, and published on May 11, 2006 as WO 2006/050313 A2, which claims the benefit of priority of U.S. Provisional Application Ser. No. 60/623,462, filed Oct. 29, 2004, and U.S. Provisional Application Ser. No. 60/700,652, filed Jul. 19, 2005. The foregoing applications and publication are incorporated herein by reference in their entirety.

This invention was made with government support under DE-FG02-91ER20021 awarded by the U.S. Department of Energy. The government has certain rights in the invention.

FIELD OF THE INVENTION

The present invention relates to genes, proteins and methods comprising molecules that alter amino acid levels in plants, and in particular relates to altering guanidino substrate hydrolysis activities in plants, arthropods and microorganisms using molecules within the arginase family and other molecules that alter amino acid levels.

BACKGROUND

Chemicals have been used for centuries to fight unwanted pests. The war against infestation of plants is a constant battle. Plant and agriculture producers try to eradicate insect species with chemicals. The nonaffected (resistant) individuals within a population are able to breed and thereby produce a new generation that is more resistant to the insecticide that was being used. Consequently, the dosage and frequency of application for that insecticide must be increased, or else something different must be used. Thus, there is a continued need to identify new methods of deturing pests from damaging plants and agricultural products.

Synthetic insecticides have found there way in to sources of water and animals that are consumed by humans such as undesirable residues of DDT, heptachlor, mirex, contaminating fish, water, and the soil. One benefit of using a natural plant insecticide is that many of them are biodegradable. Insecticides such as organo-phosphorus and carbamate esters are biodegradable, but many still manifested broad-spectrum toxicity, with a potential for poisoning nontarget insects, fish, wildlife, livestock, and humans. There are several natural (plant) insecticides that have been widely used such as rotenone and pyrethrin. Rotenone is a terpene; however, it is generally applied as a spray on fruits and row crops several times before harvesttime because the chemical residues do not linger for long periods of time. Thus, there is still a need to identify genetically engineered plants with increased resistance to predations by using genes or appropriate modifications in the plants.

SUMMARY OF THE INVENTION

The present invention relates to genes, proteins and methods comprising molecules that alter amino acid levels. In one embodiment, the present invention relates to altering guanidino substrate hydrolysis activities in plants, arthropods and microorganisms using molecules within the arginase family and other molecules that alter an amino acid levels. In one embodiment, the present invention relates to altering threonine substrate deamination and dehydration activities in plants, arthropods and microorganisms using molecules within the threonine deaminase family and other molecules that alter amino acid levels. In one embodiment, the present invention relates to using genes, proteins and methods comprising arginase or threonine deaminase for altering the pathophysiology of plants, arthropods and microorganisms. In a preferred embodiment, the present invention relates to altering guanidino substrate hydrolysis activity in plants, arthropods, and microorganisms using arginase. In another preferred embodiment, the invention relates to altering threonine substrated deamination and dehydration activity in plants, arthropods, and microorganisms using threonine deaminase. In some embodiments, the invention related to overexpression and increased activity of arginase, threonine deaminase or a proteinase inhibitor.

The present invention is not limited to any particular sequence encoding a protein having amino-acid degrading enzyme activities. In some embodiments, the invention provides a nucleic acid comprising a sequence encoded by a sequence selected from the group having an arginase and/or threonine deaminase activity. In some embodiments, the invention provides a nucleic acid comprising a sequence encoded by a sequence selected from the group having amino-acid degrading enzyme activities that is induced by insect feeding.

The present invention is not limited to any particular sequence encoding a protein having guanidino substrate hydrolysis activities. In some embodiments, the invention provides a nucleic acid comprising a sequence encoded by a sequence selected from the group consisting of SEQ ID NO:01 and sequences at least 51% identical to SEQ ID NO:01, wherein said sequence encodes a protein having guanidino substrate hydrolysis activity. In other embodiments, the present invention provides a nucleic acid at least 51%, 55%, 60%, 65%, 70%, 75%, 80%, 85%, 90%, 95%, 98%, 99% (or more) identical to any of SEQ ID NO: 01, wherein said sequence encodes a protein having guanidino substrate hydrolysis activity. In some embodiments the protein is an arginine amidinohydrolase.

In some embodiments, the invention provides an isolated nucleic acid molecule comprising a polynucleotide encoding a polypeptide at least 23% identical to SEQ ID NO:54, wherein said nucleic acid encodes a protein having guanidino substrate hydrolysis activity. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity. In some embodiments the protein is an arginine amidinohydrolase. In some embodiments, the invention provides an expression vector, comprising a nucleic acid sequence encoding a polypeptide at least 23% identical to SEQ ID NO:54, wherein said nucleic acid encodes a protein having guanidino substrate hydrolysis activity. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity. In some embodiments the protein is an arginine amidinohydrolase. In some embodiments the guanidino substrate hydrolysis activity further comprises hydrolyzing an arthropod guanidino substrate. In some embodiments the guanidino substrate hydrolysis activity further comprises depleting a guanidino substrate in an arthropod. The present invention is not limited to any particular type of arthropod. Indeed, a variety of arthropods are contemplated, including, but not limited to herbivore arthropods. In some embodiments the herbivore arthropods are contemplated, including, but not limited to members of Arthropoda, such as a chewing insect and a cell-content feeder. In some embodiments the chewing insect is chosen from one or more of the following: caterpillars, for example, Lepidoptera (moths), Coleoptera (beetles), grasshoppers, katydids and their relatives. In some embodiments the cell-content feeder is chosen from one or more of the following: Homoptera (aphids and whiteflies), Diptera (flies), and Acari (spider mites) and Thysanoptera (thrips), for example, western flower thrips (*Frankliniella occidentalis*), Heteroptera (true bugs), fungus gnats and the like. In some embodiments the arthropod is an arthropod herbivore is one or more of a tobacco hornworm, western flower thrip and two-spotted mite. In some embodiments the guanidino substrate hydrolysis activity further comprises hydrolyzing a guanidino substrate of a microorganism. The present invention is not limited to any particular type of microorganism. Indeed, a variety of microorganisms are contemplated, including, but not limited to plant pathogens. In some embodiments the microorganism is chosen from one or more of the following: *Pseudomoinas syringae* pv. tomato, fungus and the like. In some embodiments the microorganism induces plant responses, for example, inducing bacterial phytotoxin coronatine, and the like. In some embodiments the guanidino substrate is L-arginine. In some embodiments the nucleic acid sequence further encodes a polypeptide comprising a C terminus corresponding to SEQ ID NO:118. In some embodiments the polypeptide at least 23% identical to SEQ ID NO:54 is selected from the group consisting of SEQ ID NOs:54-113. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity. In some embodiments the nucleic acid sequence is selected from the group consisting of SEQ ID NOs:01-53. The present invention is not limited to any particular type of vector. Indeed, a variety of vectors are contemplated. In some embodiments, the expression vector is a eukaryotic vector. In further embodiments, the eukaryotic vector is a plant vector. In still further embodiments, the plant vector is a T-DNA vector. In other embodiments, the expression vector is a prokaryotic vector. The present invention is not limited to any particular type of promoter. Indeed, the use of a variety of promoters is contemplated. In some embodiments, the promoter is a eukaryotic promoter. In further embodiments, the eukaryotic promoter is active in a plant.

In some embodiments, the invention provides a transgenic plant comprising a heterologous nucleic acid sequence encoding a polypeptide at least 23% identical to SEQ ID NO:54, wherein said nucleic acid sequence encodes a protein having guanidino substrate hydrolysis activity. The present invention is not limited to any particular transgenic plant. In some embodiments, transgenic plants are crop plants. Indeed, a variety of transgenic plants are contemplated, including, but not limited to one or more of the following: Solanaceae, Brassicaceae, Poaceae and Coniferales. In some embodiments the transgenic plant is a tomato plant. In some embodiments the transgenic tomato plant is one or more of a Micro-Tom and a Castlemart. In some embodiments the transgenic plant is a crop plant. In some embodiments the transgenic plant is a woody plant. In some embodiments the woody plant is one or of the following: a *Pinus*, a *Picea*, and a *Populus*.

In some embodiments, the invention provides a transgenic plant cell comprising a nucleic acid sequence encoding a polypeptide at least 23% identical to SEQ ID NO:54, wherein said nucleic acid sequence encodes a protein having guanidino substrate hydrolysis activity, and wherein said nucleic acid sequence is heterologous to the plant cell. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity.

In some embodiments, the invention provides a transgenic plant seed comprising a nucleic acid sequence encoding a polypeptide at least 23% identical to SEQ ID NO:54, wherein said nucleic acid sequence encodes a protein having guanidino substrate hydrolysis activity, and wherein said nucleic acid sequence is heterologous to the plant seed. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity. In some embodiments, the invention provides a transgenic plant comprising a nucleic acid encoding a polypeptide at least 23% identical to SEQ ID NO:54 operably linked to a promoter, wherein the nucleic acid sequence encodes a protein having guanidino substrate hydrolysis activity. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity.

In some embodiments, the invention provides a method for altering the phenotype of a plant, comprising: a) providing; i) an expression vector comprising a nucleic acid sequence encoding a polypeptide at least 23% identical to SEQ ID NO:54, and ii) plant tissue; and b) introducing said vector into said plant tissue under conditions such that expression of said nucleic acid sequence alters the phenotype of a plant developed from said tissue. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity.

In some embodiments, the invention provides a method for altering amino acid ratios, comprising: a) providing a vector construct comprising a nucleic acid encoding a polypeptide at least 23% identical to SEQ ID NO:54, wherein said nucleic acid sequence encodes a protein having guanidino substrate hydrolysis activity; and b) producing a plant comprising the vector, wherein said plant exhibits an altered amino acid ratio. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity.

In some embodiments, the invention provides a method for altering the pathophysiology of a plant, comprising: a) providing; i) an expression vector comprising a nucleic acid encoding a polypeptide at least 23% identical to SEQ ID NO:54, wherein the nucleic acid sequence encodes a protein having guanidino substrate hydrolysis activity, and ii) plant tissue; and b) introducing said vector into said plant tissue under conditions such that the protein encoded by the nucleic acid sequence is expressed in a plant developed from said tissue, wherein said plant exhibits an altered pathophysiology. In other embodiments, the present invention provides a nucleic acid at least 23%, 25%, 30%, 35%, 40%, 45%, 50%, 55%, 60%, 65%, 70%, 75%, 80%, 85%, 90%, 95%; 98%, 99% (or more) identical to any of SEQ ID NO:54, wherein said sequence encodes a protein having guanidino substrate hydrolysis activity.

In some embodiments, the invention provides a method for reducing arginine in plants, comprising: a) providing a transgenic plant cell comprising a heterologous nucleic acid sequence, wherein the heterologous nucleic acid sequence encodes a polypeptide at least 23% identical to SEQ ID NO:54, under conditions sufficient for expression of the encoded protein; and b) culturing said transgenic plant cell under conditions such that arginine is reduced. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity.

In some embodiments, the invention provides a method for altering plant physiology, comprising: a) providing a transgenic plant comprising a heterologous nucleic acid sequence, wherein said heterologous nucleic acid sequence encodes a polypeptide at least 23% identical to SEQ ID NO:54; and b) cultivating said transgenic plant under conditions sufficient for increasing guanidino substrate hydrolysis activity in the plant tissue. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity.

In some embodiments, the invention provides a method for altering arthropod physiology, comprising: a) providing a transgenic plant comprising a heterologous nucleic acid sequence, wherein said heterologous nucleic acid sequence encodes a polypeptide at least 23% identical to SEQ ID NO:54; and b) feeding said transgenic plant to said arthropod under conditions sufficient for altering arthropod physiology. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity.

In some embodiments, the invention provides a method for altering arthropod physiology, comprising: a) providing a transgenic plant comprising a heterologous nucleic acid sequence, wherein said heterologous nucleic acid sequence encodes a polypeptide at least 23% identical to SEQ ID NO:54; and b) feeding said transgenic plant to said arthropod under conditions sufficient for increasing a guanidino substrate hydrolysis activity in the arthropod. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity.

In some embodiments, the invention provides a method for altering arthropod physiology, comprising: a) providing a transgenic plant comprising a heterologous nucleic acid sequence, wherein said heterologous nucleic acid sequence encodes a polypeptide at least 23% identical to SEQ ID NO:54; and b) feeding said transgenic plant to said arthropod under conditions sufficient for reducing the growth rate of the arthropod. In other embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO:54, wherein said sequence encodes a protein having guanidino substrate hydrolysis activity.

In some embodiments the invention relates to a transgenic plant comprising a non-naturally occurring nucleic acid sequence that functions to express mRNA that encodes an arginase protein.

In some embodiments the invention relates to a transgenic plant comprising a non-naturally occurring nucleic acid sequence that functions to expresses mRNA that encodes an arginase protein and a proteinase inhibitor.

In some embodiments the invention relates to a transgenic plant comprising a non-naturally occurring nucleic acid sequence that functions to expresses mRNA that encodes a threonine deaminase protein and a proteinase inhibitor.

In some embodiments the invention relates to a transgenic plant comprising a non-naturally occurring nucleic acid sequence that functions to expresses mRNA that encodes an arginase protein, a threonine deaminase protein, and a proteinase inhibitor.

In some embodiments the invention relates to a transgenic plant comprising a non-naturally occurring nucleic acid sequence that functions to express mRNA that encodes an arginase protein having a sequence selected from the group consisting of SEQ ID NO: 54 and SEQ ID NO 55 or overexpress mRNA that encodes a threonine deaminase protein having SEQ ID NO: 162 or 163. In further embodiments, the present invention provides a nucleic acid encoding a protein at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: 54, wherein said sequence encodes a protein having guanidino substrate hydrolysis activity. In further embodiments, the present invention provides a nucleic acid encoding a polypeptide at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: 55, wherein said sequence encodes a protein having guanidino substrate hydrolysis activity. In further embodiments, the present invention provides a nucleic acid encoding a polypeptide at least 23%, 25%, 30%, 35%, 40%, 45%, 50%, 55%, 60%, 65%, 70%, 75%, 80%, 85%, 90%, 95%, 98%, 99% (or more) identical to SEQ ID NO: 163, wherein said sequence encodes a protein having threonine deaminase activity.

In some embodiments the invention relates to a transgenic plant comprising a non-naturally occurring nucleic acid sequence that functions to express mRNA that encodes an arginse protein having a sequence selected from the group consisting of SEQ ID NO: 54 to SEQ ID NO 113 and/or overexpress mRNA that encodes a threoneine deaminase having a sequence selected from the group consisting of SEQ ID NO: 162 to SEQ ID NO 168. In further embodiments, the present invention provides a nucleic acid encoding a protein at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: SEQ ID NO: 54 to SEQ ID NO 113, wherein said sequence encodes a protein having guanidino substrate hydrolysis activity. In further embodiments, the present invention provides a nucleic acid encoding a protein at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: 162 to SEQ ID NO 168, wherein said sequence encodes a protein having threonine substrate deaminase activity.

In some embodiments the invention relates to a transgenic plant comprising a non-naturally occurring nucleic acid sequence that functions to express mRNA that encodes a threonine deaminase protein wherein said threonine deaminase protein has SEQ ID NO: 162. In further embodiments, the present invention provides a nucleic acid encoding a protein at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: δ 162 to SEQ ID NO 168, wherein said sequence encodes a protein having threonine deaminase activity.

In some embodiments, the invention relates to transgenic plant that overexpresses mRNA that encodes a threonine deaminase protein wherein said threonine deaminase protein has SEQ ID NO: 163. In further embodiments, the present invention provides a nucleic acid encoding a protein at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: 162 to SEQ ID NO 168, wherein said sequence encodes a protein having threonine substrate deaminase activity.

In some embodiments, the invention relates to a transgenic plant that overexpresses mRNA that encodes a threonine deaminase protein wherein said threonine deaminase protein consists essentially of a threonine deaminase transit peptide (Tp) domaine, and a threonine deaminase N-terminal catalytic domain (Cat).

In some embodiments, the invention relates to a transgenic plant that overexpresses mRNA that encodes a threonine deaminase protein wherein said threonine deaminase protein consists essentially of a threonine deaminase transit peptide (Tp) domaine, a threonine deaminase N-terminal catalytic domain (Cat), and a non-functional regulatory domain (Reg).

In some embodiments, the invention relates to a transgenic plant that overexpresses mRNA that encodes a threonine deaminase protein wherein said threonine deaminase protein consists essentially of a threonine deaminase N-terminal catalytic domain (Cat), and a non-functional regulatory domain (Reg).

In some embodiments, the invention relates to a transgenic plant that overexpresses mRNA that encodes a threonine deaminase protein wherein said threonine deaminase protein consists essentially of SEQ ID NO: 180. In further embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO 180, wherein said sequence encodes a protein having threonine substrate deaminase activity.

In some embodiments, the invention relates to a transgenic plant that overexpresses mRNA that encodes a threonine deaminase protein wherein said threonine deaminase protein consists essentially of a threonine deaminase N-terminal catalytic domain.

In some embodiments, the invention relates to a transgenic plant that overexpresses mRNA that encodes a threonine deaminase protein wherein said threonine deaminase protein consists essentially of SEQ ID NO: 181. In further embodiments, the present invention provides a nucleic acid at least 23%, 25%, 30%, 35%, 40%, 45%, 50%, 55%, 60%, 65%, 70%, 75%, 80%, 85%; 90%, 95%, 98%, 99% (or more) identical to any of SEQ ID NO 181, wherein said sequence encodes a protein having threonine substrate deaminase activity.

In some embodiments, the invention relates to a transgenic plant that overexpresses mRNA that encodes a threonine deaminase protein that functions to deaminate threonine wherein said threonine deaminase protein comprises of SEQ ID NO: 182 through 190. In further embodiments, the present invention provides a nucleic acid at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: 182 through 190, wherein said sequence encodes a protein having threonine deaminase activity.

In some embodiments, the invention relates to a dicotyledoneous plant modified with a nucleic acid sequence that encodes arginase protein.

In some embodiments, the invention relates to a dicotyledoneous plant modified with a nucleic acid sequence that encodes threonine deaminase protein.

In some embodiments, the invention relates to a dicotyledoneous plant modified with a nucleic acid sequence that encodes arginase protein and a proteinase inhibitor.

In some embodiments, the invention relates to a dicotyledoneous plant modified with a nucleic acid sequence that encodes threonine deaminase protein and a proteinase inhibitor.

In some embodiments, the invention relates to a dicotyledoneous plant modified with a nucleic acid sequence that encodes arginase protein and a nucleic acid sequence that encodes threonine deaminase protein.

In some embodiments, the invention relates to a dicotyledoneous plant modified with a nucleic acid sequence that encodes arginase protein and a nucleic acid sequence that encodes threonine deaminase protein and a proteinase inhibitor.

In some embodiments, the invention relates to a monocotyledonous plant modified with a nucleic acid sequence that encodes arginase protein.

In some embodiments, the invention relates to a monocotyledonous plant modified with a nucleic acid sequence that encodes threonine deaminase protein.

In some embodiments, the invention relates to a monocotyledonous plant modified with a nucleic acid sequence that encodes arginase protein and a proteinase inhibitor.

In some embodiments, the invention relates to a monocotyledonous plant modified with a nucleic acid sequence that encodes threonine deaminase protein and a proteinase inhibitor.

In some embodiments, the invention relates to a monocotyledonous plant modified with a nucleic acid sequence that encodes arginase protein and a nucleic acid sequence that encodes threonine deaminase protein.

In some embodiments, the invention relates to a monocotyledonous plant modified with a nucleic acid sequence that encodes arginase protein and a nucleic acid sequence that encodes threonine deaminase protein and a proteinase inhibitor.

In some embodiments, the invention relates to a method of reducing infestation of a plant comprising: a) providing a genome comprising a nucleic acid sequence that encodes threonine deaminase; b) searching said genome; c) identifying said nucleic acid sequence; c) generating a transgenic plant that overexpresses said nucleic acid sequences by Argobacterium-mediated transformation, and; e) growing said plant under conditions such that infestation of said transgenic plant is reduced.

In some embodiments, the invention relates to a method of reducing infestation of a plant comprising a) providing a nucleic acid sequence which encodes a protein capable of deaminating threonine; b) generating transgenic plants that overexpresses said nucleic acid sequences by Argobacterium-mediated transformation, and; c) growing said plant under conditions such that infestation of said plant is reduced. In further embodiments, the nucleic acid encodes a protein at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: 163, wherein said sequence encodes a protein having threonine substrate deaminase activity. In further embodiments said plant is *Nicotiana attenuate*.

In some embodiments, the invention relates to a method of reducing infestation of a plant comprising: a) providing a nucleic acid sequence which encodes a protein capable of catalyzing the hydrolysis of arginine to form urea and ornithine; b) generating transgenic plants that overexpress said nucleic acid sequences by Argobacterium-mediated transformation, and; c) growing said plant under conditions such that infestation of said plant is reduced.

In some embodiments, the invention relates to a method of reducing infestation of a plant comprising: a) providing a nucleic acid sequence which encodes a protein capable of deaminating threonine and a proteinase inhibitor; b) generating transgenic plants that overexpress said nucleic acid sequences by Argobacterium-mediated transformation, and; c) growing said plant under conditions such that infestation of said plant is reduced. In further embodiments, the nucleic acid sequence encodes a protein comprising SEQ ID NO: 163. In father embodiments, the nucleic acid encodes a protein at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: 163, wherein said sequence encodes a protein having threonine substrate deaminase activity. In further embodiments said plant is *Nicotiana attenuate*. In further embodiments, said plant is *Nicotiana attenuata*. In further embodiments said plant is *Lycopersicon esculentum*. In further embodiments, said proteinase inhibitor is Cathepsin D Inhibitor.

In some embodiments, the invention relates to a method of reducing infestation of a plant comprising: a) providing a nucleic acid sequence which encodes a protein capable of catalyzing the hydrolysis of arginine to form urea and ornithine and a proteinase inhibitor; b) generating transgenic plants that overexpress said nucleic acid sequences by Argobacterium-mediated transformation, and; c) growing said plant under conditions such that infestation of said plant is reduced.

In some embodiments, the invention relates to a method of reducing infestation of a plant comprising: a) providing a nucleic acid sequence which encodes a protein capable of catalyzing the hydrolysis of arginine to form urea and ornithine and a protiease inhibitor and which express a protein capable of deaminating threonine; b) generating transgenic plants that overexpress said nucleic acid sequences by Argobacterium-mediated transformation, and; c) growing said plant under conditions such that infestation of said plant is reduced.

In some embodiments, the invention relates to a method of reducing infestation of a plant comprising: a) providing a nucleic acid sequence which encodes a protein capable of catalyzing the hydrolysis of arginine to form urea and ormithine and a protiease inhibitor and which express a protein capable of deaminating threonine and a proteinase inhibitor; b) generating transgenic plants that overexpress said nucleic acid sequences by Argobacterium-mediated transformation, and; c) growing said plant under conditions such that infestation of said plant is reduced.

In some embodiments, the invention relates to a method of reducing infestation of a plant comprising: a) providing i) a nucleic acid sequence which encodes a protein capable of deaminating threonine, ii) a nucleic acid sequence which express a proteinase inhibitor protein, and iii) a nucleic acid sequence which express an amino peptidase Leucine Amino Peptidase b) generating transgenic plants that overexpress said nucleic acid sequences by Argobacterium-mediated transformation, and; c) growing said plant under conditions such that infestation of said plant is reduced. In further embodiments, the nucleic acid encodes a protein at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: 163, wherein said sequence encodes a protein having threonine substrate deaminase activity. In further embodiments said amino peptidase is leucine Amino Peptidase. In further embodiment, said leucine amino peptidase has SEQ ID NO: 191. In further embodiments, the nucleic acid encodes a protein at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: 191. In further embodiments, said plant is *Lycopersicon esculentum*. In further embodiments, said proteinase inhibitor protein is a Catheepsin D Inhibitor protein. In further embodiments, said Catheepin D inhibitor protein has SEQ ID NO: 192. In father embodiments, the nucleic acid encodes a protein at least 23%, 25%, 30%, 35%, 40%, 45%, 50%, 55%, 60%, 65%, 70%, 75%, 80%, 85%, 90%, 95%, 98%, 99% (or more) identical to any of SEQ ID NO: 192, wherein said sequence encodes a protein having proteolytic activity.

DESCRIPTION OF THE FIGURES

FIGS. 2A-2C show an exemplary embodiment that demonstrates a comparison of cDNA-deduced protein sequences of arginases. Members of arginase superfamily from FIG. 1 were globally aligned with the PILEUP program in GCG (Wisconsin Package version 10.2, Genetics Computer Group (GCG), Madison, Wis.). The active site region of a subset of agmatinase (AG), plant L-arginase (PA, bold) and non-plant L-arginase (NA) groups are shown. Alignment of all 85 full-length sequences is shown in FIG. 9. Amino acid residues involved in binding the $Mn^{2+}$ cofactor are identified with a "@" symbol aligned below the sequences; they are conserved in all members of the arginase family. Residues in non-plant L-arginases that are involved in binding the guanidino moiety of the substrate are denoted with the "#" symbol and are shaded. Residues in non-plant arginases that form hydrogen bonds with the α-carboxylate oxygen and the α-amino group of L-arginine are denoted by the "*" and "^" symbols, respectively, and are shaded in gray. "Plant-specific" residues conserved in all plant arginases, but not found in other family members, are indicated by underlined gray-shaded letters.

FIG. 4 shows an exemplary embodiment that demonstrates an induction of tomato arginase in response to wounding. Leaflets on three-week-old plants were mechanically wounded with a hemostat. At the times indicated, wounded leaves were harvested for extraction of RNA or protein. A control set of unwounded plants (0 point) served as a control. A, 10-μg samples of total RNA were separated on a 1.2% (w/v) denaturing agarose gel. RNA was transferred to a Hybond-N Plus membrane, and subsequently hybridized to gene-specific probes for LeARG1 and LeARG2. A duplicate RNA gel was stained with ethidium bromide (EtBr) as loading control. B, Protein extracts prepared from wounded (closed squares) and unwounded (open squares) plants were assayed for L-arginase activity. Data points show the mean±SD of three independent assays. Note that the time scale for the experiments shown in A and B are in hours and days, respectively.

FIG. 5 shows an exemplary embodiment that demonstrates an induction of tomato arginase in response to MeJA treatment. Three three-week-old tomato plants were exposed to MeJA vapor in an enclosed Lucite box. At various times thereafter, leaves were harvested for extraction of RNA or protein. A control set of untreated plants (0 point) served as a control. A, Total RNA was analyzed by blot hybridization for the presence of LeARG1 and LeARG2 transcripts as described in the legend to FIG. 4. A duplicate RNA blot was hybridized to a probe for eIF4A as a loading control. B, Protein extracts prepared from MeJA-treated (closed square) or mock-treated (open squares) plants were assayed for L-arginase activity. Data points show the mean±SD of three independent assays. Note that the time scale for the experiments shown in A and B are in hours and days, respectively.

Figure 6:
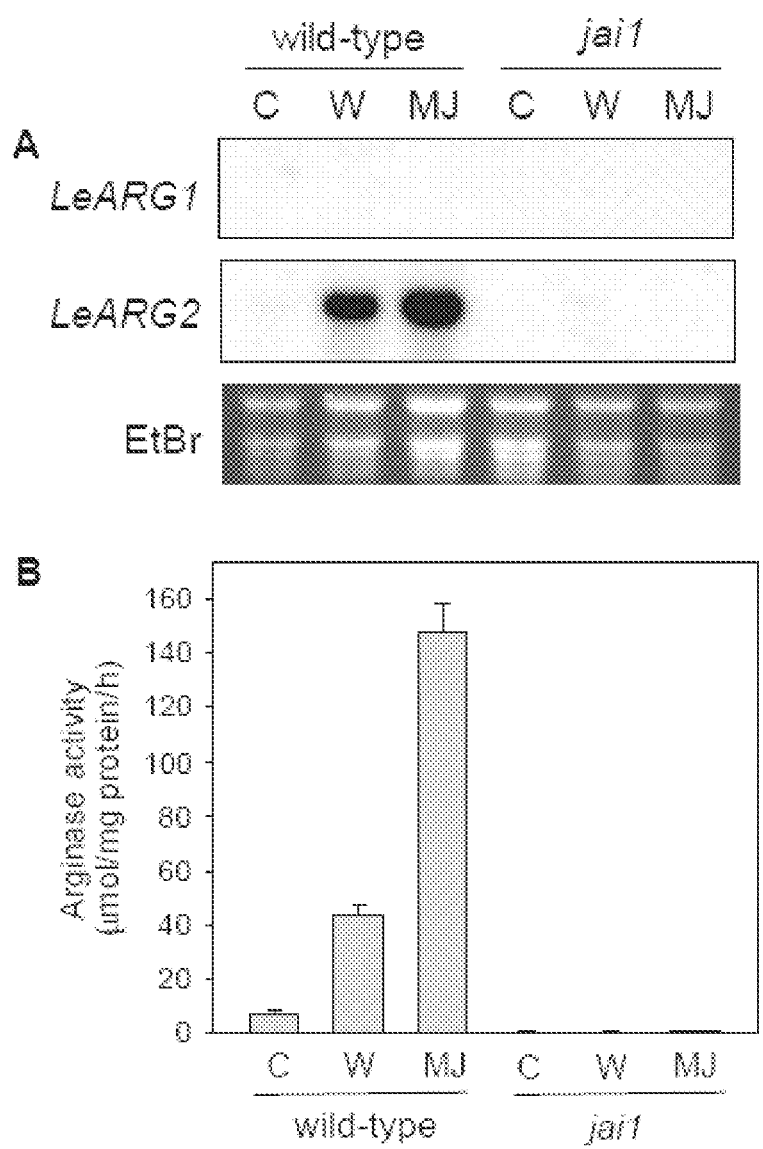

FIG. 6 shows an exemplary embodiment that demonstrates an induced expression of tomato arginase is dependent on the JA signaling pathway. A, Three sets of four-week-old wild-type (WT) and jai1 plants were grown under identical conditions. One set of plants was mechanically wounded (W), and RNA was extracted 8 h later. RNA also was prepared from a second set of plants that was treated with exogenous MeJA (J) for 8 h. A third set of control plants (C) received no treatment. Total RNA was analyzed by blot hybridization for the presence of LeARG1 and LeARG2 transcripts as described in the legend to FIG. 4. A duplicate RNA blot was hybridized to a probe for eIF4A as a loading control. B, Plants were treated as described in A. Two days after treatment, protein extracts were isolated from leaf tissue and assayed for L-arginase activity. Data points show the mean±SD of three independent measurements.

Figure 7:
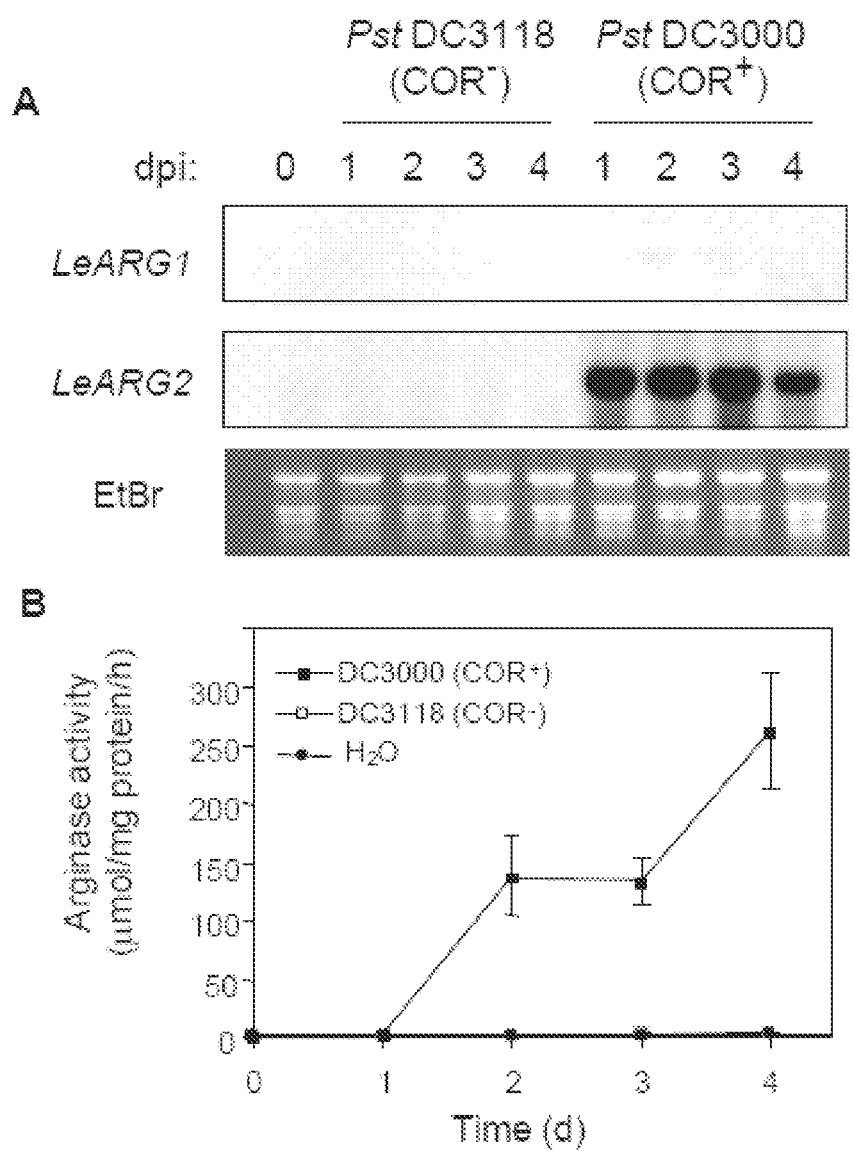

FIG. 7 shows an exemplary embodiment that demonstrates an induction of tomato arginase in response to Pst DC3000 infection. Three 3-week-old tomato plants were infected either with a strain of *P. syringae* that produces coronatine (Pst DC3000, COR$^+$) or an isogenic strain that does not produce the phytotoxin (Pst DC3118, COR$^-$). On consecutive days post-infection (dpi), leaves were harvested for extraction of RNA or protein. A control set of mock (water)-inoculated plants (0 point) served as a control. A, Total RNA was analyzed by blot hybridization for the presence of LeARG1 and LeARG2 transcripts as described in the legend to FIG. 4. A duplicate RNA blot was stained with ethidium bromide as a loading control. B, Protein extracts prepared from mock-inoculated plants (closed circles) and from plants challenged with Pst DC3000 (closed square) or Pst DC3118 (open squares) were assayed for L-arginase activity. Data points show the mean±SD of three independent measurements.

FIG. 8 shows an exemplary embodiment that demonstrates an induction of tomato arginase in response to purified coronatine. Purified coronatine (20 ng) was applied directly to the leaf surface of three 3-week-old tomato plants. At various times thereafter, leaves were harvested for extraction of RNA or protein. A control set of untreated plants (0 point) served as a control. A, Total RNA was analyzed by blot hybridization for the presence of LeARG1 and LeARG2 transcripts as described in the legend to FIG. 4. A duplicate RNA blot was stained with ethidium bromide (EtBr) as a loading control. B, Protein extracts prepared from mock-treated (open squares) or COR-treated (closed squares) leaves were assayed for L-arginase activity. Data points show the mean±SD of three independent measurements.

FIGS. 9A-9J shows an exemplary embodiment that demonstrates a phylogeny of the arginase superfamily. Amino acid sequences of 85 members of the arginase superfamily were aligned as described in the Experimental Procedures. Amino acid residues shaded in black are involved in binding the Mn$^{2+}$ cofactor and are conserved in family members. Plant-specific residues that are conserved in plant arginases but not in other family members are shaded in gray. Accession numbers are as follows: *Synechocystis* PCC6803 1 BAA16710 (SEQ ID NO: 215); *Trichodesmium erythraeum* ZP_00072558 (SEQ ID NO: 216); *Magnetococcus* MC1 ZP_00044065 (SEQ ID NO: 217); *Desulfovibrio desulfuricans* ZP_00130728 (SEQ ID NO: 218); *Coxiella burnetii* NP_819748 (SEQ ID NO: 219); *Synechococcus* WH8102 1 NP_898511 (SEQ ID NO: 220); *Prochlorococcus marinus* NP_896038 (SEQ ID NO: 221); *Bacillus anthracis* NP_653833 (SEQ ID NO:236); *Bacillus cereus* NP_835031 (SEQ ID NO: 237); *Bacillus subtilis* CAB15776 (SEQ ID NO: 238); *Clostridium thermocellum* ZP_00061115 (SEQ ID NO: 239); *Thermoanaerobacter tencongensis* NP_622953 (SEQ ID NO: 240); *Methanocaldococcus jannaschii* NP_247282 (SEQ ID NO: 241); *Methanothermus fervidus* AM72081 (SEQ ID NO: 242); *Methanothermobacter thermautotrophicus* NP_276005 (SEQ ID NO: 243); *Sulfolobus tokodaii* NP_376223 (SEQ ID NO: 244); *Sulfolobus solfataricus* NP_341979 (SEQ ID NO: 245); *Aeropyrum pernix* NP_148071 (SEQ ID NO: 246); *Methanosarcina barkeri* ZP_00076655 (SEQ ID NO: 247); *Methanosarcina mazei* NP_632947 (SEQ ID NO: 248); *Thermoplasma volcanium* NP_111057 (SEQ ID NO: 249); *Pyrococcus abyssi* NP_125782 (SEQ ID NO: 250); *Pyrococcus furiosus* NP_579686 (SEQ ID NO: 251); *Archaeoglobus fulgidus* NP_069480 (SEQ ID NO: 252); *Synechococcus* WH8102 2 NP_897505 (SEQ ID NO: 253); *Synechocystis* PCC6803 2 NP_440618 (SEQ ID NO: 254); *Vibrio vulnificus* NP_761202 (SEQ ID NO: 255); *Vibrio cholerae* NP_233200 (SEQ ID NO: 256); *Vibrio parahaemolyticus* NP_799679 (SEQ ID NO: 257); *Escherichia coli* AAG58067 (SEQ ID NO: 258); *Neisseria meningitidis* NP_273516 (SEQ ID NO: 259); *Burkholderia fungorum* 1 ZP_00029600 (SEQ ID NO: 260); *Nitrosomonas europaea* NP_841204 (SEQ ID NO: 261); *Pseudomonas fluorescens* ZP_00265302 (SEQ ID NO: 262); *Streptomyces coelicolor*

NP_733583 (SEQ ID NO: 263); Streptomyces avermitilis NP_826462 (SEQ ID NO: 264); Thermobifida fusca ZP_00057179 (SEQ ID NO: 265); Arthrobacter KUJ8602 BAB96819 (SEQ ID NO: 266); Homo sapiens 3 AAL24446 (SEQ ID NO: 267); Gallus gallus AAK97629 (SEQ ID NO: 268); Pseudomonas putida ZP_746633 (SEQ ID NO: 269); Pseudomonas aeruginosa 1 NP_250112 (SEQ ID NO; 270); Burkholderia fungorum 2 ZP_00027973 (SEQ ID NO: 271); Pseudomonas aeruginosa 2 ZP_00140720 (SEQ ID NO: 272); Sinorhizobium meliloti NP_386607 (SEQ ID NO: 274); Rhodobacter sphaeroides ZP_00004739 (SEQ ID NO: 273); Triticum aestivum TIGR unigene TC108421 (Genbank EST CD913000) (SEQ ID NO: 76); Hordeum vulgare TIGR unigene TC121657 (Genbank EST CA022688) (SEQ ID NO: 75); Zea mays AYI06166 (SEQ ID NO: 74); Oryza sativa CAE02758 (SEQ ID NO: 78); Brassica napus AAK15006 (SEQ ID NO: 224); Arabidopsis thaliana 1 AAK96469 (SEQ ID NO: 61); Solanum tuberosum TIGR unigene TC66607 (Genbank EST BM403790) (SEQ ID NO: 226); Lycopersicon esculentum 1 (Tomato 1), AY656837 (SEQ ID NO: 55); Lycopersicon esculentum 2 (Tomato 2), AY656838 (SEQ ID NO: 54); Glycine max AAC04613; Medicago truncatula TIGR unigene TC87301 (Genbank EST BI271401) (SEQ ID NO: 83); Glycine max TIGR unigene TC 181483 (Genbank EST BM308429); Arabidopsis thaliana 2 AAM64858 (SEQ ID NO: 62); Pinus taeda AAK07744 (SEQ ID NO: 157); Brucella melitensis AACO5588 (SEO ID NO: 100); Agrobacterium tumefaciens 1 NP_356634 (SEQ ID NO: 98); Agrobacterium tumefaciens 2 CAA33894 (SEQ ID NO: 99); Bradyrhizobium japonicum NP_772762 (SEQ ID NO: 97); Leishmania mexicana AAR06176 (SEQ ID NO: 103); Saccharomyces cerevisiae AAA34469 (SEQ ID NO: 104); Neurospora crassa P33280 (SEQ ID NO: 106); Schizosaccharomyces pombe CAA53236 (SEQ ID NO: 105); Bacillus subtilis CAA57400 (SEQ ID NO: 107); Bacillus caldovelox S68863 (SEQ ID NO: 108); Bacillus halodurans NP_244816 (SEQ ID NO: 285); Bacillus brevis JC5866 (SEQ ID NO: 110); Mus musculus 2 AAH23349 (SEQ ID NO: 93); Rattus norvegicus 2 NP_062041 (SEQ ID NO: 91); Homo sapiens 2 BAA13158 (SEQ ID NO: 96); Dania rerio 2 AAH56711 (SEQ ID NO: 87); Rattus norvegicus 2 NP_058830 (SEQ ID NO: 90); Mus musculus 1 AAHSO005 (SEQ ID NO: 92); Sus scrofa AAK91874 (SEQ ID NO: 94); Homo sapiens 1 AAA51776 (SEQ ID NO: 95); Xenopus laevis AAH43635 (SEQ ID NO: 88); Dania rerio 1 CAE17604 (SEQ ID NO: 290); Schistosoma japonicum AAQ16108 (SEQ ID NO: 102); Drosophila melanogaster NP_524875 (SEQ ID NO: 86); Plasmodium yoelii EAA16981 (SEQ ID NO: 101), all of which are herein incorporated by reference.

Figure 10:
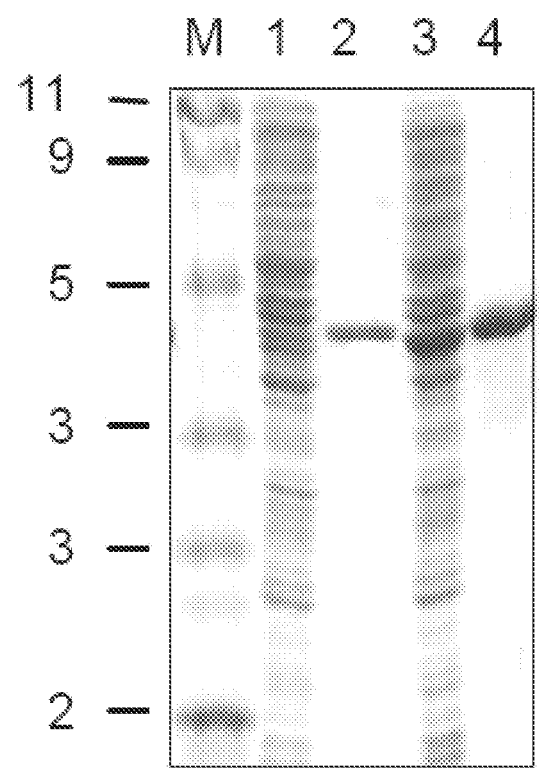

FIG. 10 shows an exemplary embodiment that demonstrates an affinity purification of LeARG1 and LeARG2 expressed in E. coli. His-tagged derivatives of LeARG1 and LeARG2 were expressed in E. coli and purified by nickel-affinity chromatography. Protein fractions were analyzed by SDS-polyacrylamide gel electrophoresis. A Coomassie blue-stained gel is shown. Lanes 1 and 3: crude extract from E. coli cells expressing LeARG1 and LARG2, respectively; lanes 2 and 4: eluate from a nickel-affinity column loaded with extracts from LeARG1- and LeARG2 expressing cells, respectively. Protein standards (M) and their corresponding molecular mass (kDa) are shown on the left.

Figure 11:
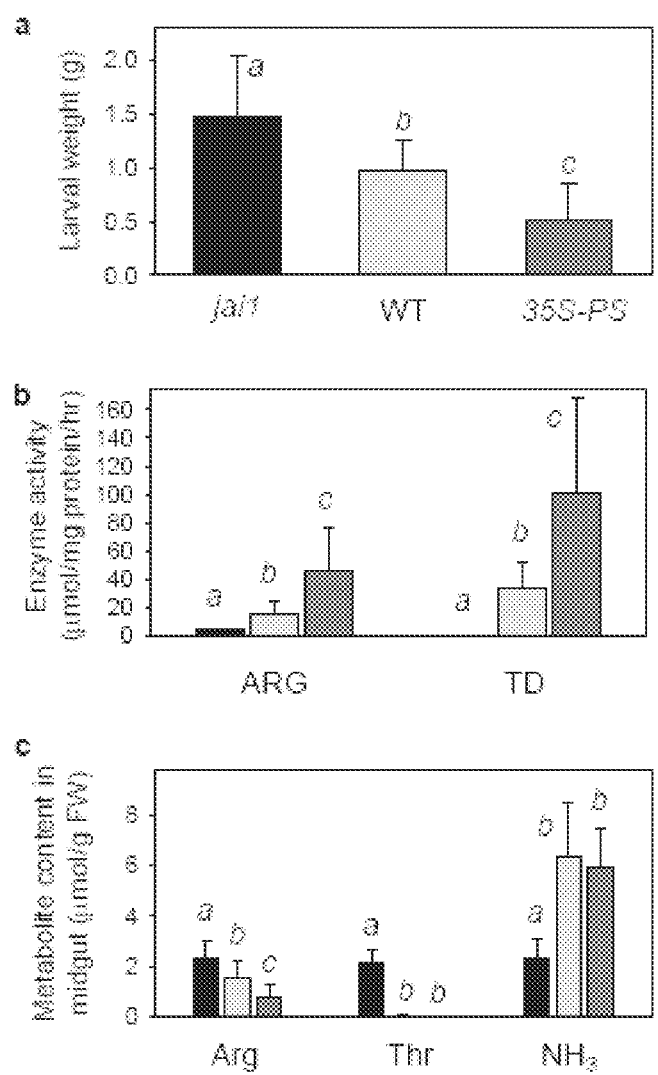

FIG. 11 shows Jasmonate-regulated plant enzymes are active in the insect midgut. a, M. sexta larvae (initial weight ~35 mg) were grown on the indicated host plant for 7 days, after which larval weights were determined. Data show the mean±sd of at least 23 larvae per host genotype. b, ARG and TD activity in midgut extracts from larvae that were grown on jail (black bar), WT (light gray bar), and 35S-PS (dark gray bar) plants. Data show the mean±sd of 10 larvae per plant genotype. c, Arg, Thr, and $NH_3$ levels in midgut extracts from the same larvae used in b. Data show the mean±sd. Italicized letters denote significant differences (unpaired students's t-test) at $P<0.05$.

Figure 12:
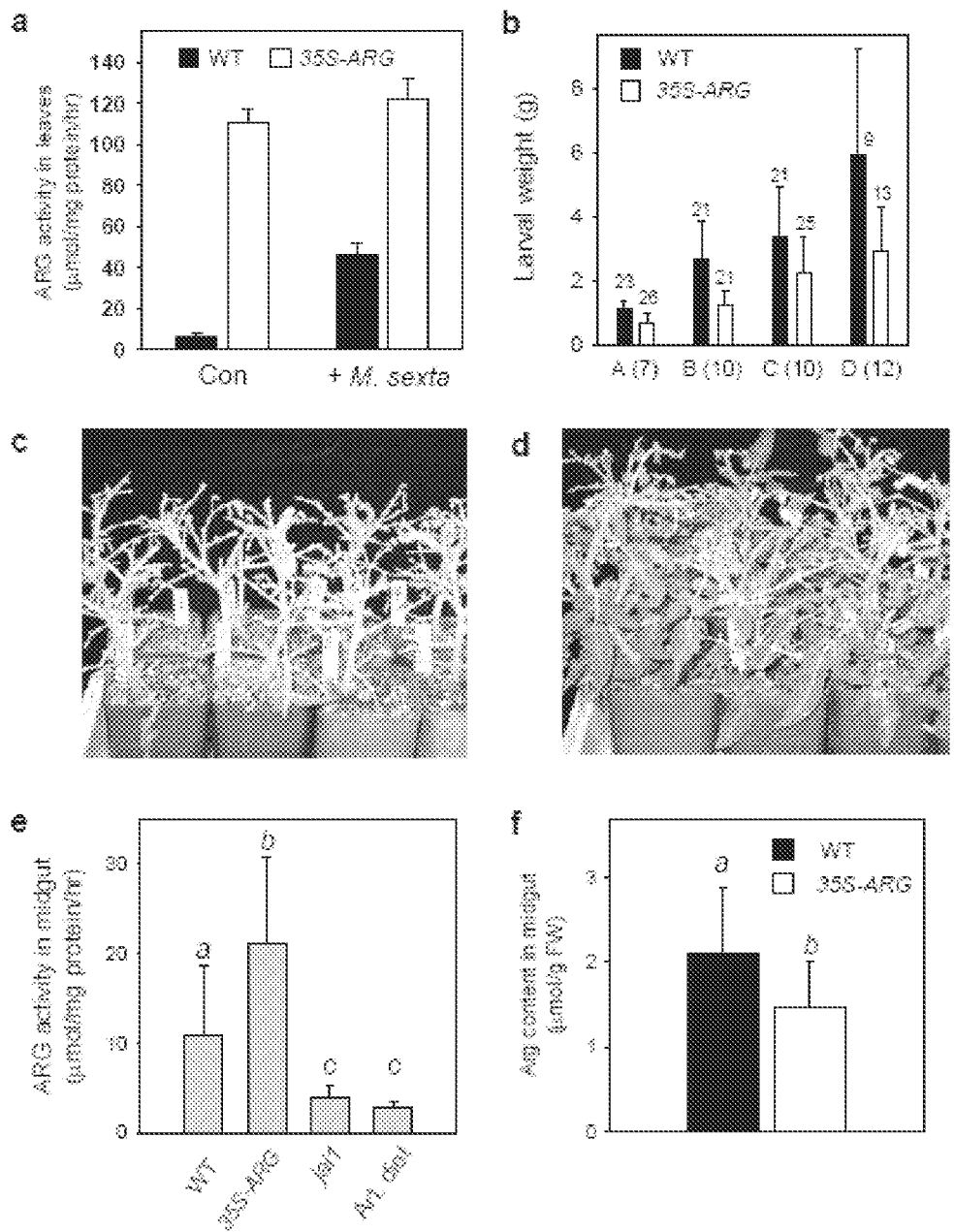

FIG. 12 shows overexpression of ARG in tomato leaves depletes Arg availability in the M. sexta midgut and increases host resistance. a, ARG activity in leaves of unwounded control (Con) and M. sexta-damaged (10 days post-challenge) WT (filled bar) and 35S-ARG (open bar) plants. b, Results of four (A-D) independent feeding trials of M. sexta on WT (filled bar) and 35S-ARG (open bar) plants. Numbers in parentheses indicate the duration (days) of each trial. Significant differences in larval weights ($P<0.01$) were observed in all four trials. The number of larvae in each data set is indicated above the bar. c-d, Photograph of WT (c) and 35S-ARG (d) plants after feeding by M. sexta larvae for 10 days. e, ARG activity in midgut extracts from larvae reared on the indicated host plant or on artificial diet. f, Arg levels in midgut extracts from larvae reared on WT and 35S-ARG plants. Data in e and f show the mean±sd (n=10 larvae). Italicized letters denote significant differences (unpaired students's t-test) at $P<0.05$.

Figure 13:
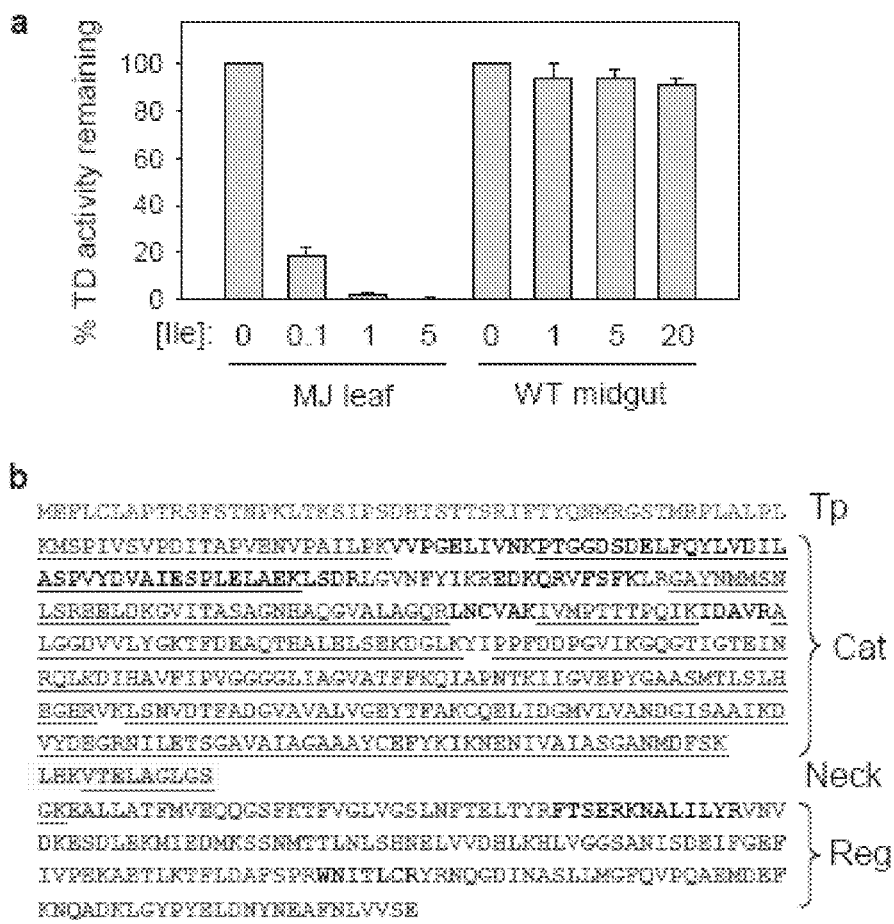

FIG. 13 shows Midgut TD is insensitive to negative feedback regulation by isoleucine. a, Extracts from methyl-JA (MJ)-treated tomato leaves (MJ leaf) and midguts from larvae grown on WT plants (WT midgut) were assayed for TD activity in the absence (0) or presence of different concentrations (mM) of Ile. Data were normalized to the amount of activity observed in the absence of Ile (100%), and show the mean±sd of three independent experiments. b, Complete amino acid sequence of tomato TD Accession No. A38628 SEQ ID NO: 162. Based on the three-dimensional structure of Escherichia coli TD amino acid sequences corresponding to the N-terminal catalytic (Cat) domain and the C-terminal regulatory (Reg) domain of the tomato enzyme are indicated. The short "neck" region that connects the two domains. Sequences of the transit peptide (Tp) targets TD to the chloroplast. Amino acid sequences identified for midgut TD are underlined. SEQ ID NO: 163.

DEFINITIONS

To facilitate an understanding of the present invention, a number of terms and phrases as used herein are defined below:

The use of the article "a" or "an" is intended to include one or more.

The term plant cell "compartments or organelles" is used in its broadest sense. The term includes but is not limited to, the endoplasmic reticulum, Golgi apparatus, trans Golgi network, plastids, sarcoplasmic reticulum, glyoxysomes, mitochondrial, chloroplast, thylakoid membranes and nuclear membranes, and the like.

The term "gene" refers to a nucleic acid (e.g., DNA or RNA) sequence that comprises coding sequences necessary for the production of an RNA, or a polypeptide or its precursor (e.g., proinsulin). A functional polypeptide can be encoded by a full-length coding sequence or by any portion of the coding sequence as long as the desired activity or functional properties (e.g., enzymatic activity, ligand binding, signal transduction, etc.) of the polypeptide are retained. The term "portion" when used in reference to a gene refers to fragments of that gene. The fragments may range in size from a few nucleotides to the entire gene sequence minus one nucleotide. The term "a nucleotide comprising at least a portion of a gene" may comprise fragments of the gene or the entire gene. The term "cDNA" refers to a nucleotide copy of the "messenger RNA" or "mRNA" for a gene. In some embodiments, cDNA is derived from the mRNA. In some embodiments, cDNA is derived from genomic sequences. In some embodiments, cDNA is derived from EST sequences. In some embodiments, cDNA is derived from assembling portions of coding regions extracted from a variety of BACs, contigs, Scaffolds and the like.

The term "BAC" and "bacterial artificial chromosome" refers to a vector carrying a genomic DNA insert, typically 100-200 kb. The term "SSLP" and "simple sequence length polymorphisms" refers to a unit sequence of DNA (2 to 4 bp) that is repeated multiple times in tandem wherein common examples of these in mammalian genomes include runs of dinucleotide or trinucleotide repeats (for example, CACA-CACACACACACACA)."

The term "EST" and "expressed sequence tag" refers to a unique stretch of DNA within a coding region of a gene; approximately 200 to 600 base pairs in length.

The term "contig" refers to an overlapping collection of sequences or clones.

The term "gene" encompasses the coding regions of a structural gene and includes sequences located adjacent to the coding region on both the 5' and 3' ends for a distance of about 1 kb on either end such that the gene corresponds to the length of the full-length mRNA.

The sequences which are located 5' of the coding region and which are present on the mRNA are referred to as 5' non-translated sequences. The sequences which are located 3' or downstream of the coding region and which are present on the mRNA are referred to as 3' non-translated sequences. The term "gene" encompasses both cDNA and genomic forms of a gene. A genomic form or clone of a gene contains the coding region termed "exon" or "expressed regions" or "expressed sequences" interrupted with non-coding sequences termed "introns" or "intervening regions" or "intervening sequences." Introns are segments of a gene that are transcribed into nuclear RNA (hnRNA); introns may contain regulatory elements such as enhancers. Introns are removed or "spliced out" from the nuclear or primary transcript; introns therefore are absent in the messenger RNA (mRNA) transcript. The mRNA functions during translation to specify the sequence or order of amino acids in a nascent polypeptide.

In addition to containing introns, genomic forms of a gene may also include sequences located on both the 5' and 3' end of the sequences that are present on the RNA transcript. These sequences are referred to as "flanking" sequences or regions (these flanking sequences are located 5' or 3' to the non-translated sequences present on the mRNA transcript). The 5' flanking region may contain regulatory sequences such as promoters and enhancers that control or influence the transcription of the gene. The 3' flanking region may contain sequences that direct the termination of transcription, post-transcriptional cleavage and polyadenylation.

The terms "allele" and "alleles" refer to each version of a gene for a same locus that has more than one sequence. For example, there are multiple alleles for eye color at the same locus.

The terms "recessive," "recessive gene," and "recessive phenotype" refers to an allele that has a phenotype when two alleles for a certain locus are the same as in "homozygous" or as in "homozygote" and then partially or fully loses that phenotype when paired with a more dominant allele as when two alleles for a certain locus are different as in "heterozygous" or in "heterozygote." The terms "dominant," "dominant," and "dominant phenotype" refers to an allele that has an effect to suppress the expression of the other allele in a heterozygous (having one dominant and one recessive allele) condition.

The term "heterologous" when used in reference to a gene or nucleic acid refers to a gene that has been manipulated in some way. For example, a heterologous gene includes a gene from one species introduced into another species. A heterologous gene also includes a gene native to an organism that has been altered in some way (e.g., mutated, added in multiple copies, linked to a non-native promoter or enhancer sequence, etc.). Heterologous genes may comprise plant gene sequences that comprise cDNA forms of a plant gene; the cDNA sequences may be expressed in either a sense (to produce mRNA) or anti-sense orientation (to produce an anti-sense RNA transcript that is complementary to the mRNA transcript). Heterologous genes are distinguished from endogenous plant genes in that the heterologous gene sequences are typically joined to nucleotide sequences comprising regulatory elements such as promoters that are not found naturally associated with the gene for the protein encoded by the heterologous gene or with plant gene sequences in the chromosome, or are associated with portions of the chromosome not found in nature (e.g., genes expressed in loci where the gene is not normally expressed).

The term "nucleic acid sequence," "nucleotide sequence of interest" or "nucleic acid sequence of interest" refers to any nucleotide sequence (e.g., RNA or DNA), the manipulation of which may be deemed desirable for any reason (e.g., treat disease, confer improved qualities, etc.), by one of ordinary skill in the art. Such nucleotide sequences include, but are not limited to, coding sequences of structural genes (e.g., reporter genes, selection marker genes, oncogenes, drug resistance genes, growth factors, etc.), and non-coding regulatory sequences which do not encode an mRNA or protein product (e.g., promoter sequence, polyadenylation sequence, termination sequence, enhancer sequence, etc.).

The term "structural" when used in reference to a gene or to a nucleotide or nucleic acid sequence refers to a gene or a nucleotide or nucleic acid sequence whose ultimate expression product is a protein (such as an enzyme or a structural protein), an rRNA, an sRNA, a tRNA, etc.

The term "oligonucleotide" refers to a molecule comprised of two or more deoxyribonucleotides or ribonucleotides, preferably more than three, and usually more than ten. The exact size will depend on many factors, which in turn depends on the ultimate function or use of the oligonucleotide. The oligonucleotide may be generated in any manner, including chemical synthesis, DNA replication, reverse transcription, or a combination thereof.

The term "polynucleotide" refers to refers to a molecule comprised of several deoxyribonucleotides or ribomicleotides, and is used interchangeably with oligonucleotide. Typically, oligonucleotide refers to shorter lengths, and polynucleotide refers to longer lengths, of nucleic acid sequences.

The term "an oligonucleotide (or polypeptide) having a nucleotide sequence encoding a gene" or "a nucleic acid sequence encoding" a specified polypeptide refers to a nucleic acid sequence comprising the coding region of a gene or in other words the nucleic acid sequence which encodes a gene product. The coding region may be present in either a cDNA, genomic DNA or RNA form. When present in a DNA form, the oligonucleotide may be single-stranded (i.e., the sense strand) or double-stranded. Suitable control elements such as enhancers/promoters, splice junctions, polyadenylation signals, etc. may be placed in close proximity to the coding region of the gene if needed to permit proper initiation of transcription and/or correct processing of the primary RNA transcript. Alternatively, the coding region utilized in the expression vectors of the present invention may contain endogenous enhancers, exogenous promoters, splice junctions, intervening sequences, polyadenylation signals, etc. or a combination of both endogenous and exogenous control elements. The term "exogenous promote"

The terms "complementary" and "complementarity" refer to polynucleotides (i.e., a sequence of nucleotides) related by the base-pairing rules. For example, for the sequence "A-G-T," is complementary to the sequence "T-C-A." Complementarity may be "partial," in which some of the nucleic acids' bases are matched according to the base pairing rules. Or, there may be "complete" or "total" complementarity between the nucleic acids. The degree of complementarity between nucleic acid strands has significant effects on the efficiency and strength of hybridization between nucleic acid strands. This is of particular importance in amplification reactions, as well as detection methods that depend upon binding between nucleic acids.

The term "SNP" and "Single Nucleotide Polymorphism" refers to a single base difference found when comparing the same DNA sequence from two different individuals.

The term "partially homologous nucleic acid sequence" refers to a sequence that at least partially inhibits (or competes with) a completely complementary sequence from hybridizing to a target nucleic acid and is referred to using the functional term "substantially homologous." The inhibition of hybridization of the completely complementary sequence to the target sequence may be examined using a hybridization assay (Southern or Northern blot, solution hybridization and the like) under conditions of low stringency. A substantially homologous sequence or probe will compete for and inhibit the binding (i.e., the hybridization) of a sequence that is completely complementary to a target under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target which lacks even a partial degree of identity (e.g., less than about 30% identity); in the absence of non-specific binding the probe will not hybridize to the second non-identical target.

The term "substantially homologous" when used in reference to a double-stranded nucleic acid sequence such as a cDNA or genomic clone refers to any probe that can hybridize to either or both strands of the double-stranded nucleic acid sequence under conditions of low to high stringency as described above.

The term "substantially homologous" when used in reference to a single-stranded nucleic acid sequence refers to any probe that can hybridize (i.e., it is the complement of) the single-stranded nucleic acid sequence under conditions of low to high stringency as described above.

The term "hybridization" refers to the pairing of complementary nucleic acids. Hybridization and the strength of hybridization (i.e., the strength of the association between the nucleic acids) is impacted by such factors as the degree of complementary between the nucleic acids, stringency of the conditions involved, the $T_m$ of the formed hybrid, and the G:C ratio within the nucleic acids. A single molecule that contains pairing of complementary nucleic acids within its structure is said to be "self-hybridized."

The term "$T_m$" refers to the "melting temperature" of a nucleic acid. The melting temperature is the temperature at which a population of double-stranded nucleic acid molecules becomes half dissociated into single strands. The equation for calculating the $T_m$ of nucleic acids is well known in the art. As indicated by standard references, a simple estimate of the $T_m$ value may be calculated by the equation: $T_m=81.5+0.41$ (% G+C), when a nucleic acid is in aqueous solution at 1 M NaCl (See e.g., Anderson and Young, Quantitative Filter Hybridization, in *Nucleic Acid Hybridization* (1985)). Other references include more sophisticated computations that take structural as well as sequence characteristics into account for the calculation of $T_m$.

The term "stringency" refers to the conditions of temperature, ionic strength, and the presence of other compounds such as organic solvents, under which nucleic acid hybridizations are conducted. With "high stringency" conditions, nucleic acid base pairing will occur between nucleic acid fragments that have a high frequency of complementary base sequences. Thus, conditions of "low" stringency are often required with nucleic acids that are derived from organisms that are genetically diverse, as the frequency of complementary sequences is usually less.

"Low stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4H_2O$ and 1.85 g/l EDTA, pH adjusted to 7.4 with NaOH), 0.1% SDS, 5×Denhardt's reagent (50×Denhardt's contains per 500 ml: 5 g Ficoll (Type 400, Pharmacia), 5 g BSA (Fraction V; Sigma)) and 100 µg/ml denatured salmon sperm DNA followed by washing in a solution comprising 5×SSPE, 0.1% SDS at 42° C. when a probe of about 500 nucleotides in length is employed.

"Medium stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4H_2O$ and 1.85 g/l EDTA, pH adjusted to 7.4 with NaOH), 0.5% SDS, 5×Denhardt's reagent and 100 µg/ml denatured salmon sperm DNA followed by washing in a solution comprising 1.0×SSPE, 1.0% SDS at 42° C. when a probe of about 500 nucleotides in length is employed.

"High stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4H_2O$ and 1.85 g/l EDTA, pH adjusted to 7.4 with NaOH), 0.5% SDS, 5×Denhardt's reagent and 100 µg/ml denatured salmon sperm DNA followed by washing in a solution comprising 0.1×SSPE, 1.0% SDS at 42° C. when a probe of about 500 nucleotides in length is employed.

It is well known that numerous equivalent conditions may be employed to comprise low stringency conditions; factors such as the length and nature (DNA, RNA, base composition) of the probe and nature of the target (DNA, RNA, base composition, present in solution or immobilized, etc.) and the concentration of the salts and other components (e.g., the presence or absence of formamide, dextran sulfate, polyethylene glycol) are considered and the hybridization solution may be varied to generate conditions of low stringency hybridization different from, but equivalent to, the above listed conditions. In addition, the art knows conditions that promote hybridization under conditions of high stringency (e.g., increasing the temperature of the hybridization and/or wash steps, the use of formamide in the hybridization solution, etc.).

The term "expression" or "express" when used in reference to a nucleic acid sequence, such as a gene, refers to the process of converting genetic information encoded in a gene into RNA (e.g., mRNA, rRNA, tRNA, or snRNA) through "transcription" of the gene (i.e., via the enzymatic action of an RNA polymerase), and into protein where applicable (as when a gene encodes a protein), through "translation" of mRNA. Gene expression can be regulated at many stages in the process. "Up-regulation" or "activation" refers to regulation that increases the production of gene expression products (i.e., RNA or protein), while "down-regulation" or "repression" refers to regulation that decrease production. Molecules (e.g., transcription factors) that are involved in up-regulation or down-regulation are often called "activators" and "repressors," respectively.

The terms "in operable combination", "in operable order" and "operably linked" refer to the linkage of nucleic acid sequences in such a manner that a nucleic acid molecule capable of directing the transcription of a given gene and/or the synthesis of a desired protein molecule is produced. The term also refers to the linkage of amino acid sequences in such a manner so that a functional protein is produced.

The term "regulatory element" refers to a genetic element that controls some aspect of the expression of nucleic acid sequences. For example, a promoter is a regulatory element that facilitates the initiation of transcription of an operably linked coding region. Other regulatory elements are splicing signals, polyadenylation signals, termination signals, etc.

Transcriptional control signals in eukaryotes comprise "promoter" and "enhancer" elements. Promoters and enhancers consist of short arrays of DNA sequences that interact specifically with cellular proteins involved in transcription (Maniatis, et al., Science 236:1237, (1987), herein incorporated by reference). Promoter and enhancer elements have been isolated from a variety of eukaryotic sources including genes in yeast, insect, mammalian and plant cells. Promoter and enhancer elements have also been isolated from viruses and analogous control elements, such as promoters, are also found in prokaryotes. The selection of a particular promoter and enhancer depends on the cell type used to express the protein of interest. Some eukaryotic promoters and enhancers have a broad host range while others are functional in a limited subset of cell types (for review, see Maniatis, et al., supra (1987), herein incorporated by reference).

The terms "promoter element," "promoter," or "promoter sequence" refer to a DNA sequence that is located at the 5' end (i.e. precedes) of the coding region of a DNA polymer. The location of most promoters known in nature precedes the transcribed region. The promoter functions as a switch, activating the expression of a gene. If the gene is activated, it is said to be transcribed, or participating in transcription. Transcription involves the synthesis of mRNA from the gene. The promoter, therefore, serves as a transcriptional regulatory element and also provides a site for initiation of transcription of the gene into mRNA.

The term "regulatory region" refers to a gene's 5' transcribed but untranslated regions, located immediately downstream from the promoter and ending just prior to the translational start of the gene.

The term "promoter region" refers to the region immediately upstream of the coding region of a DNA polymer, and is typically between about 500 bp and 4 kb in length, and is preferably about 1 to 1.5 kb in length.

Promoters may be tissue specific or cell specific. The term "tissue specific" as it applies to a promoter refers to a promoter that is capable of directing selective expression of a nucleotide sequence of interest to a specific type of tissue (e.g., seeds) in the relative absence of expression of the same nucleotide sequence of interest in a different type of tissue (e.g., leaves). Tissue specificity of a promoter may be evaluated by, for example, operably linking a reporter gene to the promoter sequence to generate a reporter construct, introducing the reporter construct into the genome of a plant such that the reporter construct is integrated into every tissue of the resulting transgenic plant, and detecting the expression of the reporter gene (e.g., detecting mRNA, protein, or the activity of a protein encoded by the reporter gene) in different tissues of the transgenic plant. The detection of a greater level of expression of the reporter gene in one or more tissues relative to the level of expression of the reporter gene in other tissues shows that the promoter is specific for the tissues in which greater levels of expression are detected. The term "cell type specific" as applied to a promoter refers to a promoter that is capable of directing selective expression of a nucleotide sequence of interest in a specific type of cell in the relative absence of expression of the same nucleotide sequence of interest in a different type of cell within the same tissue. The term "cell type specific" when applied to a promoter also means a promoter capable of promoting selective expression of a nucleotide sequence of interest in a region within a single tissue. Cell type specificity of a promoter may be assessed using methods well known in the art, e.g., immunohistochemical staining. Briefly, tissue sections are embedded in paraffin, and paraffin sections are reacted with a primary antibody that is specific for the polypeptide product encoded by the nucleotide sequence of interest whose expression is controlled by the promoter. A labeled (e.g., peroxidase conjugated) secondary antibody that is specific for the primary antibody is allowed to bind to the sectioned tissue and specific binding detected (e.g., with avidin/biotin) by microscopy.

Promoters may be "constitutive" or "inducible." The term "constitutive" when made in reference to a promoter means that the promoter is capable of directing transcription of an operably linked nucleic acid sequence in the absence of a stimulus (e.g., heat shock, chemicals, light, etc.). Typically, constitutive promoters are capable of directing expression of a transgene in substantially any cell and any tissue. Exemplary constitutive plant promoters include, but are not limited to SD Cauliflower Mosaic Virus (CaMV SD; see e.g., U.S. Pat. No. 5,352,605, incorporated herein by reference), mannopine synthase, octopine synthase (ocs), superpromoter (see e.g., WO 95/14098, herein incorporated by reference), and ubi3 promoters (see e.g., Garbarino and Belknap, Plant Mol. Biol. 24:119-127 (1994), herein incorporated by reference). Such promoters have been used successfully to direct the expression of heterologous nucleic acid sequences in transformed plant tissue.

In contrast, an "inducible" promoter is one that is capable of directing a level of transcription of an operably linked nucleic acid sequence in the presence of a stimulus (e.g., heat shock, chemicals, light, etc.) that is different from the level of transcription of the operably linked nucleic acid sequence in the absence of the stimulus.

The term "regulatory element" refers to a genetic element that controls some aspect of the expression of nucleic acid sequence(s). For example, a promoter is a regulatory element that facilitates the initiation of transcription of an operably linked coding region. Other regulatory elements are splicing signals, polyadenylation signals, termination signals, etc.

The enhancer and/or promoter may be "endogenous" or "exogenous" or "heterologous." An "endogenous" enhancer or promoter is one that is naturally linked with a given gene in the genome. An "exogenous" or "heterologous" enhancer or promoter is one that is placed in juxtaposition to a gene by means of genetic manipulation (i.e., molecular biological techniques) such that transcription of the gene is directed by the linked enhancer or promoter. For example, an endogenous promoter in operable combination with a first gene can be isolated, removed, and placed in operable combination with a second gene, thereby making it a "heterologous promoter" in operable combination with the second gene. A variety of such combinations are contemplated (e.g., the first and second genes can be from the same species, or from different species).

The term "naturally linked" or "naturally located" when used in reference to the relative positions of nucleic acid sequences means that the nucleic acid sequences exist in nature in the relative positions.

The presence of "splicing signals" on an expression vector often results in higher levels of expression of the recombinant transcript in eukaryotic host cells. Splicing signals mediate the removal of introns from the primary RNA transcript and consist of a splice donor and acceptor site (Sambrook, et al., *Molecular Cloning: A Laboratory Manual*, 2nd ed., Cold Spring Harbor Laboratory Press, New York (1989) pp. 16.7-16.8, herein incorporated by reference). A commonly used splice donor and acceptor site is the splice junction from the 16S RNA of SV40.

Efficient expression of recombinant DNA sequences in eukaryotic cells requires expression of signals directing the efficient termination and polyadenylation of the resulting transcript. Transcription termination signals are generally found downstream of the polyadenylation signal and are a few hundred nucleotides in length. The term "poly(A) site" or "poly(A) sequence" as used herein denotes a DNA sequence which directs both the termination and polyadenylation of the nascent RNA transcript. Efficient polyadenylation of the recombinant transcript is desirable, as transcripts lacking a poly(A) tail are unstable and are rapidly degraded. The poly (A) signal utilized in an expression vector may be "heterologous" or "endogenous." An endogenous poly(A) signal is one that is found naturally at the 3' end of the coding region of a given gene in the genome. A heterologous poly(A) signal is one which has been isolated from one gene and positioned 3' to another gene. A commonly used heterologous poly(A) signal is the SV40 poly(A) signal. The SV40 poly(A) signal is contained on a 237 bp BamHI/BclI restriction fragment and directs both termination and polyadenylation (Sambrook, supra, at 16.6-16.7).

The term "vector" refers to nucleic acid molecules that transfer DNA segment(s). Transfer can be into a cell, cell to cell, etc. The term "vehicle" is sometimes used interchangeably with "vector."

The term "transfection" refers to the introduction of foreign DNA into cells. Transfection may be accomplished by a variety of means known to the art including calcium phosphate-DNA co-precipitation, DEAE-dextran-mediated transfection, polybrene-mediated transfection, glass beads, electroporation, microinjection, liposome fusion, lipofection, protoplast fusion, viral infection, biolistics (i.e., particle bombardment) and the like.

The term "stable transfection" or "stably transfected" refers to the introduction and integration of foreign DNA into the genome of the transfected cell. The term "stable transfectant" refers to a cell that has stably integrated foreign DNA into the genomic DNA.

The term "transient transfection" or "transiently transfected" refers to the introduction of foreign DNA into a cell where the foreign DNA fails to integrate into the genome of the transfected cell. The foreign DNA persists in the nucleus of the transfected cell for several days. During this time the foreign DNA is subject to the regulatory controls that govern the expression of endogenous genes in the chromosomes. The term "transient transfectant" refers to cells that have taken up foreign DNA but have failed to integrate this DNA.

The term "calcium phosphate co-precipitation" refers to a technique for the introduction of nucleic acids into a cell. The uptake of nucleic acids by cells is enhanced when the nucleic acid is presented as a calcium phosphate-nucleic acid co-precipitate. The original technique of Graham and van der Eb (Graham and van der Eb, Virol., 52:456 (1973), herein incorporated by reference), has been modified by several groups to optimize conditions for particular types of cells. The art is well aware of these numerous modifications.

The terms "infecting" and "infection" when used with a bacterium refer to co-incubation of a target biological sample, (e.g., cell, tissue, etc.) with the bacterium under conditions such that nucleic acid sequences contained within the bacterium are introduced into one or more cells of the target biological sample.

The terms "bombarding, "bombardment," and "biolistic bombardment" refer to the process of accelerating particles towards a target biological sample (e.g., cell, tissue, etc.) to effect wounding of the cell membrane of a cell in the target biological sample and/or entry of the particles into the target biological sample. Methods for biolistic bombardment are known in the art (e.g., U.S. Pat. No. 5,584,807, herein incorporated by reference), and are commercially available (e.g., the helium gas-driven microprojectile accelerator (PDS-1000/He, BioRad).

The term "microwounding" when made in reference to plant tissue refers to the introduction of microscopic wounds in that tissue. Microwounding may be achieved by, for example, particle bombardment as described herein.

The term "transgene" refers to a foreign gene that is placed into an organism by the process of transfection. The term "foreign gene" refers to any nucleic acid (e.g., gene sequence) that is introduced into the genome of an organism by experimental manipulations and may include gene sequences found in that organism so long as the introduced gene does not reside in the same location as does the naturally-occurring gene.

The terms "transformants" or "transformed cells" include the primary transformed cell and cultures derived from that cell without regard to the number of transfers. Resulting progeny may not be precisely identical in DNA content, due to deliberate or inadvertent mutations. Mutant progeny that have the same functionality as screened for in the originally transformed cell are included in the definition of transformants.

The term "selectable marker" refers to a gene which encodes an enzyme having an activity that confers resistance to an antibiotic or drug upon the cell in which the selectable marker is expressed, or which confers expression of a trait which can be detected (e.g., luminescence or fluorescence). Selectable markers may be "positive" or "negative." Examples of positive selectable markers include the neomycin phosphotrasferase (NPTII) gene that confers resistance to G418 and to kanamycin, and the bacterial hygromycin phosphotransferase gene (hyg), which confers resistance to the antibiotic hygromycin. Negative selectable markers encode an enzymatic activity whose expression is cytotoxic to the cell when grown in an appropriate selective medium. For example, the HSV-tk gene is commonly used as a negative selectable marker. Expression of the HSV-tk gene in cells grown in the presence of gancyclovir or acyclovir is cytotoxic; thus, growth of cells in selective medium containing gancyclovir or acyclovir selects against cells capable of expressing a functional HSV TK enzyme.

The term "reporter gene" refers to a gene encoding a protein that may be assayed. Examples of reporter genes include, but are not limited to, luciferase (See, e.g., de Wet et al, Mol.

Cell. Biol. 7(2):725-237 (1987) and U.S. Pat. Nos. 6,074,859; 5,976,796; 5,674,713; and 5,618,682; all of which are herein incorporated by reference), green fluorescent protein (e.g., GenBank Accession Number U43284; a number of GFP variants are commercially available from CLONTECH Laboratories, Palo Alto, Calif., herein incorporated by reference), chloramphenicol acetyltransferase, β-galactosidase, alkaline phosphatase, and horse radish peroxidase.

The term "wild-type" when made in reference to a gene refers to a functional gene common throughout an outbred population. The term "wild-type" when made in reference to a gene product refers to a functional gene product common throughout an outbred population. A functional wild-type gene is that which is most frequently observed in a population and is thus arbitrarily designated the "normal" or "wild-type" form of the gene. In contrast, the term "modified" or "mutant" when made in reference to a gene or to a gene product refers, respectively, to a gene or to a gene product which displays modifications in sequence and/or functional properties (i.e., altered characteristics) when compared to the wild-type gene or gene product.

The term "antisense" refers to a deoxyribonucleotide sequence whose sequence of deoxyribonucleotide residues is in reverse 5' to 3' orientation in relation to the sequence of deoxyribonucleotide residues in a sense strand of a DNA duplex. A "sense strand" of a DNA duplex refers to a strand in a DNA duplex that is transcribed by a cell in its natural state into a "sense mRNA." Thus an "antisense" sequence is a sequence having the same sequence as the non-coding strand in a DNA duplex. The term "antisense RNA" refers to a RNA transcript that is complementary to the entire target transcript or part of a target primary transcript or mRNA and that blocks the expression of a target gene by interfering with the processing, transport and/or translation of its primary transcript or mRNA. The complementarity of an antisense RNA may be with any part of the specific gene transcript, i.e., at the 5' non-coding sequence, 3' non-coding sequence, introns, or the coding sequence. In addition, as used herein, antisense RNA may contain regions of ribozyme sequences that increase the efficacy of antisense RNA to block gene expression. "Ribozyme" refers to a catalytic RNA and includes sequence-specific endoribonucleases. "Antisense inhibition" refers to the production of antisense RNA transcripts capable of preventing the expression of the target protein.

The term "posttranscriptional gene silencing" or "PTGS" refers to silencing of gene expression in plants after transcription, and appears to involve the specific degradation of mRNAs synthesized from gene repeats.

The term "overexpression" generally refers to the production of a gene product in transgenic organisms that exceeds levels of production in normal or non-transformed organisms. For example, overexpression of an *Arabidopsis* hexokinase in tomato plants is show in Dai et al., Overexpression of *Arabidopsis* hexokinase in tomato plants inhibits growth, reduces photosynthesis, and induces rapid senescence., Plant Cell, 11(7):1253-1266, 1999. The term "cosuppression" refers to the expression of a foreign gene that has substantial homology to an endogenous gene resulting in the suppression of expression of both the foreign and the endogenous gene. As used herein, the term "altered levels" refers to the production of gene product(s) in transgenic organisms in amounts or proportions that differ from that of normal or non-transformed organisms.

The terms "overexpression" and "overexpressing" and grammatical equivalents, are specifically used in reference to levels of mRNA to indicate a level of expression approximately 3-fold higher than that typically observed in a given tissue in a control or non-transgenic animal. Levels of mRNA are measured using any of a number of techniques known to those skilled in the art including, but not limited to Northern blot analysis. Appropriate controls are included on the Northern blot to control for differences in the amount of RNA loaded from each tissue analyzed (e.g., the amount of 28S rRNA, an abundant RNA transcript present at essentially the same amount in tissues used for comparison, present in each sample can be used as a means of normalizing or standardizing the RAD50 mRNA-specific signal observed on Northern blots).

The terms "protein," "polypeptide," "peptide," "encoded product," "amino acid sequence," are used interchangeably to refer to compounds comprising amino acids joined via peptide bonds and. A "protein" encoded by a gene is not limited to the amino acid sequence encoded by the gene, but includes post-translational modifications of the protein. Where the term "amino acid sequence" is recited herein to refer to an amino acid sequence of a protein molecule, the term "amino acid sequence" and like terms, such as "polypeptide" or "protein" are not meant to limit the amino acid sequence to the complete, native amino acid sequence associated with the recited protein molecule. Furthermore, an "amino acid sequence" can be deduced from the nucleic acid sequence encoding the protein. The deduced amino acid sequence from a coding nucleic acid sequence includes sequences which are derived from the deduced amino acid sequence and modified by post-translational processing, where modifications include but not limited to glycosylation, hydroxylations, phosphorylations, and amino acid deletions, substitutions, and additions. Thus, an amino acid sequence comprising a deduced amino acid sequence is understood to include post-translational modifications of the encoded and deduced amino acid sequence.

The term "isolated" when used in relation to a nucleic acid or polypeptide, as in "an isolated oligonucleotide" refers to a nucleic acid sequence that is identified and separated from at least one contaminant nucleic acid with which it is ordinarily associated in its natural source. Isolated nucleic acid is present in a form or setting that is different from that in which it is found in nature. In contrast, non-isolated nucleic acids, such as DNA and RNA, are found in the state they exist in nature. For example, a given DNA sequence (e.g., a gene) is found on the host cell chromosome in proximity to neighboring genes; RNA sequences, such as a specific mRNA sequence encoding a specific protein, are found in the cell as a mixture with numerous other mRNAs that encode a multitude of proteins. However, isolated nucleic acid encoding a particular protein includes, by way of example, such nucleic acid in cells ordinarily expressing the protein, where the nucleic acid is in a chromosomal location different from that of natural cells, or is otherwise flanked by a different nucleic acid sequence than that found in nature. The isolated nucleic acid or oligonucleotide may be present in single-stranded or double-stranded form. When an isolated nucleic acid or oligonucleotide is to be utilized to express a protein, the oligonucleotide will contain at a minimum the sense or coding strand (i.e., the oligonucleotide may single-stranded), but may contain both the sense and anti-sense strands (i.e., the oligonucleotide may be double-stranded).

The term "purified" refers to molecules, either nucleic or amino acid sequences, that are removed from their natural environment, isolated or separated. An "isolated nucleic acid sequence" is therefore a purified nucleic acid sequence. "Substantially purified" molecules are at least 60% free, preferably at least 75% free, and more preferably at least 90% free from other components with which they are naturally associated.

As used herein, the term "purified" or "to purify" also refer to the removal of contaminants from a sample. The removal of contaminating proteins results in an increase in the percent of polypeptide of interest in the sample. In another example, recombinant polypeptides are expressed in plant, bacterial, yeast, or mammalian host cells and the polypeptides are purified by the removal of host cell proteins; the percent of recombinant polypeptides is thereby increased in the sample.

The term "portion" when used in reference to a protein (as in "a portion of a given protein") refers to fragments of that protein. The fragments may range in size from four amino acid residues to the entire amino sequence minus one amino acid.

The term "sample" is used in its broadest sense. In one sense it can refer to a plant cell or tissue. In another sense, it is meant to include a specimen or culture obtained from any source, as well as biological and environmental samples. Biological samples may be obtained from plants or animals (including humans) and encompass fluids, solids, tissues, and gases. Environmental samples include environmental material such as surface matter, soil, water, and industrial samples. These examples are not to be construed as limiting the sample types applicable to the present invention.

The term "positional cloning" refers to an identification of a gene based on its physical location in the genome.

The terms "arthropoda" and "arthropoda" refer to a branch (phylum) of the animal kingdom whose members have jointed legs and are also made up of rings or segments. For example, worms, insects, crustaceans, and the like.

The terms "insect" and "insecta" refer to a class of small animals with three pairs of jointed legs and one pair of antennae, at least in the adult phase for example, mole crickets, tachinid flies, and sphecid wasps all have this arrangement in the adult phase, and mole cricket nymphs. As used herein, some insect larvae (ex., grubs) are legless and spiders and ticks have four pairs of jointed legs.

The terms "beetle" and "beetles" refer to any species in the order of insects called Coleoptera that has four wings of which the outer pair are modified into stiff covers (elytra) that protect the inner pair when at rest.

The term "host" refer to any organism (animal or plant) fed upon by a parasite or parasitoid. As used herein, when insects or nematodes feed upon plants they are considered parasites of those plants, and the plants are then referred to as host plants.

The term "host plant resistance" refer to any one of the preferred methods for minimizing the damage caused by pests, bacteria, virus, fungi and the like.

"Argobacterium-mediated transformation" means use of a non-naturally occurring *Agrobacterium* as a gene vector for a plant by placing nucleic acids between the T-DNA borders to be transferred to the plant host. Gelvin (2003) *Agrobacterium*-mediated plant transformation: the biology behind the "gene-jockeying" tool. Microbiol Mol Biol Rev 67: 16-37. Functions for *Agrobacterium*-host cell DNA transfer are coded by a tumor-inducing (Ti) plasmid that resides in the bacterial cell and carries two important genetic components: the vir (virulence) region and the T-DNA delimited by two 25-bp direct repeats at its ends, termed the T-DNA borders. The vir region comprises seven major loci, virA, virB, virC, virD, virE, virG, and virH, which encode most of the bacterial protein machinery (Vir proteins) of the DNA transport. After induction of vir gene expression by small phenolic signal molecules secreted from wounded susceptible plant cells, the T-DNA borders are nicked by the bacterial VirD2 endonuclease generating a transferable single-stranded (ss) copy of the bottom strand of the T-DNA region, designated the T strand. The T strand is thought to directly associate with two *Agrobacterium* proteins, VirD2 and VirE2, forming a transport (T) complex in which one molecule of VirD2 is covalently attached to the 5'-end of the T strand, whereas VirE2, an ssDNA-binding protein, is presumed to cooperatively coat the rest of the T strand molecule. DNA placed between the T-DNA borders will be transferred to the plant host. Modified *Agrobacterium* strains that can transfer and stably integrate virtually any gene to a variety of plant species including dicots such as tomatos and monocots such such as rice (Hiei et al., 1994 (1994) Efficient transformation of rice (*Oryza sativa* L.) mediated by *Agrobacterium* and sequence analysis of the boundaries of the T-DNA. Plant J 6: 271-282) and corn (Ishida et al., 1996 (1996) High efficiency transformation of maize (*Zea mays* L.) mediated by *Agrobacterium tumefaciens*. Nat Biotechnol 14: 745-750).

"Transgenic plant" means genetically modified plants that are created by the process of genetic engineering to move genetic material into the plant with the aim of changing characteristics including: identification of a gene that would impart a useful character to the target plant; modification of the target gene for expression in plants; incorporation of the modified gene construct into the target plant genome; and regeneration of whole plants capable of transmitting the incorporated target gene to the next generation.

"Non-naturally occurring nucleic acid sequence" means a nucleic acid sequence in that would not exist in the wild without human intervention.

"Arginase protein" means a polypeptide that that catalyzes the hydrolysis of arginine to form urea and ornithine. Examples are provided in Table 3; however, it is not intended that the polypeptide be limited by any particular peptide sequence.

"Proteinase inhibitor" means any protein that inhibits proteolysis caused by enzyme that catalyzes the splitting of proteins into smaller peptide fractions and amino acids such as, but not limited to, trypsin. It is not intenden that inhibition is accomplished by any particular mechanism. Most protease inhibitors mimic the substrate of the protease, and directly contact, and thereby block the active site of the enzyme, i.e. "canonical" inhibitors. In other cases, the inhibitor does not bind directly to the substrate-binding site of the protease, but instead sterically prevents the uptake of the substrate. A third "mousetrap" mechanism of inhibition in which by structural changes the protein entraps the target protease.

"Infestation of a plant" means a feeding by arthropoda, bacteria, virus, or fungi of the plant in numbers large enough to be sufficient harmful for growth.

"Threonine deaminase peptide" means any natural or non-naturally occurring protein that that catalyzes the deamination and dehydrate threonine to alpha-ketobuterate and ammonia, i.e., comprised a threonine deaminase N-terminal catalytic domain (Cat). It is not intended that the protein be comprised of any particular sequence. The protein may contain peptide sequences that are not necessary for catalysis. For example, some naturally occurring threonine deaminase proteins comprise a "Threonine deaminase transit peptide (Tp) domain" which is a peptide sequence within the protein that directs the location of the peptide to a particular plant cell or group of cells. For example, threonine deaminase peptide may comprise a functional or non-functioning isoleusine regulatory domain (Reg).

As used herein, the term "amino acid degradation pathway enzyme" refers to enzymes that act in some way in the degradation of an amino acid. Examples include, but are not limited to arginase and threonine deaminase.

DESCRIPTION OF THE INVENTION

The present invention relates to genes, proteins and methods comprising molecules that alter amino acid levels. In one embodiment, the present invention relates to altering guanidino substrate hydrolysis activities in plants, arthropods and microorganisms using molecules within the arginase family and other molecules that alter amino acid levels. In one embodiment, the present invention relates to altering threonine substrate deamination and dehydration activities in plants, arthropods and microorganisms using moleculest within the threonine deaminase family and other molecules that alter amino acid levels. In one embodiment, the present invention relates to using genes, proteins and methods comprising arginase or threonine deaminase for altering the pathophysiology of plants, arthropods and microorganisms. In a preferred embodiment, the present invention relates to altering guanidino substrate hydrolysis activity in plants, arthropods, and microorganisms using arginase. In another preferred embodiment, the invention relates to altering threonine substrate deamination and dehydration activity in plants, arthropods, and microorganisms using threonine deaminase. In some embodiments, the invention related to overexpression and increased activity of arginase, threonine deaminase and a proteinase inhibitor.

In some embodiments, the invention relates to plants genetically modified to overexpress threonine deaminase and/or arginase and/or proteinase inhibitors for the purpose of defending the plants from the consumption of herbivores. Although the applicants do not intend the invention to be limited to any particular mechanism, it is believed that because arginase or threonine deaminase are involved in amino acid metabolism, overexpression of these enzymes are part of a defense strategy to starve herbivores of essential nutrients. They act in the midgut of a herbivore to deplete nutritional pools of arginine and threonine. It has been discovered that plants that are damaged from insect feedings up-regulate threonine deaminase and arginase, which is signaled by the plant hormone jasmonic acid. It is also believed that threonine deaminase action is enhanced by proteolytic removal of the enzyme's regulatory domain that confers negative feedback regulation by isoleucine.

It is known that transcripts encoding Threonine deaminase (TD) and a putative retrotransposon were absent in control plants, but were strongly induced after insect attack in a plant-herbivore system: *Nicotiana attenuata* Torr. ex Wats.-*Manduca sexta*. Hermsmeier et al., "Molecular Interactions between the Specialist Herbivore *Manduca sexta* (Lepidoptera, Sphingidae) and Its Natural Host *Nicotiana attenuata*. I. Large-Scale Changes in the Accumulation of Growth- and Defense-Related Plant mRNAs" Plant Physiology, Feb. 1, 2001; 125(2): 683-700. Schittko et al., "Molecular Interactions between the Specialist Herbivore *Manduca sexta* (Lepidoptera, Sphingidae) and Its Natural Host *Nicotiana attenuata*. II. Accumulation of Plant mRNAs in Response to Insect-Derived Cues" Plant Physiology, Feb. 1, 2001; 125(2): 701-710.

The rapid growth rate of leaf-eating insects is dependent on the efficient acquisition and utilization of essential amino acids that are limiting in their diet. Our studies suggest that induced defenses in tomato have evolved to exploit this nutritional vulnerability through the synergistic action of proteinase inhibitors (PIs) and a suit of other enzymes that disrupt insect digestive physiology. The theory that low nutrient quality can evolve as a plant defense has been largely discounted in favor of the prevailing view that plant antiherbivore defense is mediated by secondary metabolites. Our studies demonstrate the importance of midgut-active proteins as a strategy to hinder herbivore performance. One embodiment of the current invention relates the nonnatural expression of proteins in plants that provide resistance to a broad range of herbivores whose activity is tailored to different gut physiochemisty (i.e., pH). The diversity of plant enzymes capable of metabolizing nutrients on which leaf-eating insects depend is an important factor in the evolution of induced host resistance and, from the applied perspective, is useful for controlling insects in agricultural ecosystems.

Plants have evolved numerous defensive mechanisms to cope with the threat of phytophagous insects. One strategy employed by species throughout the plant kingdom is the induced expression of foliar compounds that exert toxic, antinutritional, or antifeedant effects on herbivores. This form of host immunity requires the wound-induced accumulation jasmonic acid (JA), which powerfully activates the transcription of a large set of target genes. In one embodiment, the current invention relates to the identification of JA-regulated transcriptional responses responsible for reduced herbivore performance. The most studied defensive JA-inducible proteins (JIPs) are proteinase inhibitors (PIs) that disrupt digestive proteases in the insect midgut. In some embodiments, the current invention relates to decreased growth of insects that feed on plants that are modified to provide nonnatural expression of several enzymes in plants that exert a combination of toxic, antinutritive, and antifeedant effects.

The phytohormone jasmonic acid (JA) regulates plant resistance to many herbivores. JA activates the expression of a large set of target genes in response to herbivory; however, only a few of these have been shown to play a role in thwarting insect attack. When studying JA-inducible proteins (JIPs) that interfere with digestive processes in lepidopteran larvae, we used a mass spectrometry-based approach to identify host proteins that accumulate in the midgut of *Manduca sexta* larvae reared on tomato (*Solanum lycopersicum*) plants. We discovered that JIPs significantly alter the gut protein content, and that two proteins, arginase (ARG) and threonine deaminase (TD), act in the gut to deplete the essential amino acids Arg and Thr, respectively. We also discovered that midgut TD activity was enhanced by proteolytic removal of the enzyme's regulatory domain that, in planta, confers negative feedback regulation by Ile. Our results indicate that induced resistance of tomato involves host enzymes that act within the herbivore digestive tract to impair the acquisition of essential nutrients.

The response of tomato plants to attack by the lepidopteran specialist, *Manduca sexta*, has been used as a model system in which to study the molecular basis of induced resistance. To assess the contribution of the JA signaling pathway to the outcome of this plant-insect interaction, we measured the weight gain of *M. sexta* larvae reared on wild-type (WT) plants and various mutants that are altered in JA signaling. The weight gain of larvae grown on WT plants was significantly less than that of larvae reared on the jail-1 mutant that is insensitive to JA. Conversely, larvae performed significantly better on WT plants than they did on a transgenic line (35S-PS) in which JIPs are constitutively expressed as a result of overexpression of prosystemin, a positive regulator of the JA signaling pathway. These host genotype-specific differences in larval performance presumably reflect the combined effects of all JA-regulated defenses, and provide a starting point for identifying specific phytochemicals that contribute to resistance.

We set out to discover other factors that induced resistance of other than PIs. We used liquid chromatography-tandem mass spectrometry (LC-MS/MS) to perform a non-biased survey of the midgut protein content of larvae that were grown on WT, 35S-PS, and jail plants. Seventy tomato proteins were confidently identified (P<0.01 for at least two peptides/protein) in a least one of the midgut samples. Among 29 proteins identified in 35S-PS midguts, genes encoding 9 of these were regulated by JA. Five of these proteins satisfied the additional criteria of being identified in WT midgut extracts but not in midguts from jail-reared larvae (as provided in Table 6). Thus, some embodiments of the current invention relate to altering the expression of these proteins, by methods including, but not limited to, producing transgentic plants that overexpress said proteins for the purpose of preventing herbivoirs from feeding on the plants.

Both the extent of amino acid sequence coverage and the number of spectral counts obtained for a given protein by LC-MS/MS is strongly correlated with protein abundance. Based on these parameters and the normalization of spectral counts to a reference protein (plastocyanin) found all midgut samples, it was apparent that JIps were among the most abundant proteins in the midgut extract. Thus, the JA signaling pathway in tomato strongly influences the dietary protein content of M. sexta larvae.

Among the JIPs identified in the midgut were arginase (ARG), which degrades Arginine to urea and ornithine, and threonine deaminase (TD), which metabolizes Threonine by deamination and dehydration to α-ketobutyrate and $NH_3$. Because Arg and Thr are dietary requirements for M. sexta and most other phytophagous insects, this finding suggests that ARG and TD act in the insect gut to deplete these essential nutrients. Midgut extracts from larvae reared on jail plants or artificial diet contained low levels of ARG activity and no detectable TD activity. Significantly higher levels of enzyme activity were found in midgut extracts from larvae grown on induced plants, indicating that these JIPs retain activity in the M. sexta gut. The high pH optimum of tomato ARG and TD suggested that they are metabolically active in the alkaline environment (pH ~9.5) of the midgut. Consistent with this idea, we found that ARG activity was inversely correlated with the level of free Arg in midgut extracts. Little or no Thr was detected in midguts from larvae grown on induced plants. In contrast, Thr was readily detectable in jail midguts that lack TD activity. Thr accumulation in all midgut extracts was inversely proportional to the level of $NH_3$, which is generated by TD-catalyzed breakdown of Thr. These results suggest that active forms of JA-regulated ARG and TD function in the larval digestive tract to reduce the availability of amino acids that are needed for insect growth.

We used a transgenic approach to determine whether increased expression of foliar ARG is sufficient to affect midgut Arg levels and larvae performance. Transgenic plants that overexpress the tomato ARG2 cDNA under the control of the Cauliflower mosaic virus 35S promoter were generated by Argobacterium-mediated transformation. The constitutive level of ARG activity in unwounded leaves of selected 35S-ARG lines far exceeded that in herbivore-damaged WT leaves. High ARG activity in these plants did not result in obvious morphological or reproductive phenotypes, and did not significantly alter the level of Arg in 35S-ARG leaves. In four independent feeding trials conducted with two 35S-ARG lines, the average weight of larvae grown on transgenic plants was significantly less than that of larvae reared on WT plants. It also was apparent that larvae consumed more foliage from WT than 35S-ARG plants. ARG activity in midgut extracts from 35S-ARG-reared larvae was significantly greater than that in WT-reared larvae, and this activity was associated with reduced levels of midgut Arg. Thus, ingestion of foliar ARG by M. sexta larvae results in the depletion of midgut Arg and reduced larval growth.

In plants and microorganisms, TD catalyzes the conunitted step in the biosynthesis of branch-chain amino acids. The enzyme contains an N-terminal catalytic domain and a C-terminal regulatory domain, and is subject to negative feedback regulation by Ile. The high level of midgut TD activity in larvae grown on induced plants suggested that the regulatory properties of the enzyme can be altered in a way that enhances Thr degradation in the presence of high concentrations of Ile. To test this idea, we compared the sensitivity of plant- and midgut-derived forms of TD to Ile. TD activity in methyl-JA-treated leaves was strongly inhibited by Ile. In midgut extracts, TD activity was not significantly inhibited by concentrations of Ile up to 20 mM. LC-MS/MS data showed that amino acid sequence coverage of the midgut form of TD mapped exclusively to the N-terminal catalytic domain and the short "neck" region that connects the regulatory and catalytic domains. Thus, it was discovered that the induced midgut-derived form of TD lacks the Ile regulatory domain. Failure to detect peptide fragments within the regulatory domain did not result from an intrinsic property of tomato TD, as LC-MS/MS analysis of the protein isolated from intact tomato tissues identified peptides that spanned >85% of this domain. It is possible that the regulatory domain of TD is proteolytically cleaved from the catalytic domain during the ingestion or digestion of leaf material, resulting in an enzyme that efficiently degrades Thr in the insect gut. In mammalian cells, induced expression of arginase in response to wound trauma and pathogen infection plays an important role in regulating the metabolism of L-arginine to either polyamines or nitric oxide (NO). In higher plants, which also utilize arginine for the production of polyamines and NO, the potential role of arginase as a control point for arginine homeostasis has not been investigated. Here, we report the characterization of two genes (LeARG1 and LeARG2) from Lycopersicon esculentum (tomato) that encode arginase. Phylogenic analysis showed that LeARG1 and LeARG2, like other plant arginases, are more similar to agmatinase than to arginases from vertebrates, fungi, and bacteria. Nevertheless, recombinant LeARG1 and LeARG2 exhibited specificity for L-arginine over agmatine and related guanidino substrates. The plant enzymes, like mammalian arginases, were inhibited (Ki ~14 µM) by the NO precursor $N^G$-hydroxy-L-arginine. These results indicate that plant arginases define a distinct group of ureohydrolases that function as authentic L-arginases. LeARG1 and LeARG2 transcripts accumulated to their highest levels in reproductive tissues. In leaves, LeARG2 expression and arginase activity were induced in response to wounding and treatment with jasmonic acid (JA), a potent signal for plant defense responses. Wound- and JA-induced expression of LeARG2 was not observed in the tomato jasmonic acid-insensitive1 mutant, indicating that this response is dependent on an intact JA signal transduction pathway. Infection of wild-type plants with a virulent strain of Pseudomonas syringae pv. tomato also upregulated LeARG2 expression and arginase activity. This response was mediated by the bacterial phytotoxin coronatine, which exerts its virulence effects by co-opting the host JA signaling pathway. These results highlight striking similarities in the regulation of arginase in plants and animals, and suggest that stress-induced arginase may perform similar roles in diverse biological systems. An example of a contemplated embodiment for producing a transgenic tomato plant is shown in Steffens, of polyphenol oxidase in transgenic tomato plants results in enhanced bacterial insect resistance. Planta, 215(2):239-247 (2002) wherein transgenic tomato (*Lycopersicon esculentum* Mill. cv. Money Maker) plants were produced that overexpressed a potato (*Solanum tuberosum* L.) PPO cDNA that exhibited a great increase in resistance to *P. syringae*, using a cauliflower mosaic virus 35S (CAMV 35S) promoter, herein incorporated by reference.

Use of CAMV 35S to overexpress enzymes involved in the biosynthesis of amino acids involved in the conversion of threonine to 3-hydroxybutyrate (3HB) and 3-hydroxy-valerate (3HV) copolymer end product, including threonine deaminase, is mentioned in Randall et al. "Use of DNA encoding plastid pyruvate dehydrogenase and branched chain oxoacid dehydrogenase components to enhance polyhydroxyalkanoate biosynthesis in plants" U.S. Pat. No. 6,773,917; however, no particular construct of threonine deaminase is disclosed.

The present invention also provides methods for using arginase amd threonine deaminase genes, and arginase or threonine deaminase polypeptides; such methods include but are not limited to use of these genes to produce transgenic plants, to increase guanidino substrate hydrolysis, to decrease guanidino substrate hydrolysis, to alter guanidino substrate hydrolysis, to alter phenotypes, and for controlled arthropod resistance. The present invention also provides methods for using threonine deaminase genes, and threonine deaminase polypeptides; such methods include but are not limited to use of these genes to produce transgenic plants, to produce isoleucine, to increase deamination of threonine, to decrease threonine, to alter threonine, to alter phenotypes, and for controlled arthropod resistance. It may be desirable to target the nucleic acid sequence of interest to a particular locus on the plant genome. Site-directed integration of the nucleic acid sequence of interest into the plant cell genome, for example gene targeting, may be achieved by, for example, homologous recombination using *Agrobacterium*-derived sequences.

Some embodiments of the present invention contemplate compositions and methods for accomplishing homologous recombination and gene targeting. For example, exogenous nucleotides for replacing endogenous nucleotides can be accomplished by a variety of transformation methods. It is not meant to limit the types of transformation methods. Contemplated transformation methods specific for tomato plants include compositions and methods comprising *Agrobacterium tumefaciens* as demonstrated in rice in U.S. Pat. Nos. 6,329,571; 5,591,616; and potatoes U.S. Pat. No. 5,925,804, all of which are herein incorporated by reference.

In some embodiments, the present invention is not limited to the use of any particular homolog or variant or mutant of arginase protein or arginase gene. Indeed, in some embodiments a variety of arginase proteins or arginase genes, variants and mutants may be used so long as they retain at least some of the activity of altering guanidino substrate hydrolysis. In particular, it is contemplated that proteins encoded by the nucleic acids of SEQ ID NOs: 01-53, find use in the present invention. In particular, it is contemplated that nucleic acids encoding polypeptides at least 51% identical to SEQ ID NO:01 and the corresponding encoded proteins find use in the present invention. Accordingly in some embodiments, the percent identity is at least 51%, 55%, 60%, 70%, 80%, 90%, 95% (or more). Functional variants can be screened for by expressing the variant in an appropriate vector in a plant cell and analyzing the guanidino substrate hydrolysis activities of the plant.

In some embodiments, the present invention is not limited to the use of any particular homolog or variant or mutant of threonine deaminase protein or threonine deaminase gene. Indeed, in some embodiments a variety of threonine deaminase proteins or genes, variants and mutants may be used so long as they retain at least some of the activity of deaminase and/or dehydrating threonine. In particular, it is contemplated that proteins encoded by the amino acid sequences SEQ ID NOs: 162 and 163 find use in the present invention. In particular, it is contemplated that nucleic acids encoding polypeptides at least 50% identical to SEQ ID NO:162 and 163 and the corresponding encoded proteins find use in the present invention. Accordingly in some embodiments, the percent identity is at least 51%, 55%, 60%, 70%, 80%, 90%, 95% (or more). Functional variants can be screened for by expressing the variant in an appropriate vector in a plant cell and analyzing threonine deaminase activities of the plant.

L-arginine is one of the most functionally diverse amino acids in living cells. In addition to serving as a constituent of proteins, arginine is a precursor for the biosynthesis of polyamines, agmatine, and proline, as well as the cell-signaling molecules glutamate, g-aminobutyric acid, and nitric oxide (NO) (Wu et al., Biochem. J. 336:1-17 (1998); Morris, Annu. Rev. Nutr. 22:87-105 (2002); Cederbaum et al., Mol. Genet. Metab. Suppl 1:S38-44 (2004)). Two of the most intensively studied pathways of arginine metabolism are those catalyzed by arginase and NO synthase (NOS). Arginase hydrolyzes arginine to urea and ornithine, the latter of which is a precursor for polyamine biosynthesis. Recent studies in animal systems indicate that increased arginase expression stimulates the production of polyamines that promote tumor cell proliferation (Chang et al., Cancer Res. 61:1100-1106 (2001)), wound healing (Satriano et al., Ann. N.Y. Acad. Sci. 1009:34-43 (2003)), and axonal regeneration following injury (Cai et al., Neuron 35:711-719 (2002)). Juxtaposed to the growth-promoting effects of polyamines are the cytostatic effects of NO produced by activated macrophages. The switch between the arginase and NOS branches of arginine metabolism is controlled by various inflammatory signals that regulate arginase expression and arginine availability (Morris, Annu. Rev. Nutr. 22:87-105 (2002), Lee et al., Proc. Natl. Acad. Sci. U.S.A. 100:4843-4848 (2003); Bronte et al., Trends Immunol. 24:302-306 (2003); Hallemeesch et al., Clin. Nutr. 21:273-279 (2002)). Because arginase and NOS compete for a common substrate, increased arginase expression can effectively attenuate the NOS pathway, often with profound physiological consequences. A diversity of human pathogens, for example, induce arginase expression as a means of evading NO-mediated host defenses (Duleu et al., J. Immunol. 172:6298-6303 (2004); Gobert et al., Proc. Natl. Acad. Sci. U.S.A. 98:13844-13849 (2001); Iniesta et al., Parasite Immunol. 24:113-118 (2002); Vincendeau et al., Trends Parasitol. 19:9-12 (2003)). The interaction between the arginase and NOS pathways extends beyond the fact that they both use a common substrate. For example, the intermediate in the NOS-catalyzed production of NO, NG-hydroxy-L-arginine (NOHA), functions as a potent inhibitor of arginase (Boucher et al., Biochem. Biophys. Res. Commun. 203:1614-1621 (1994); Daghigh et al., Biochem. Biophys. Res: Commun. 202:174-180 (1994)).

In contrast to our understanding of arginase regulation in animals, very little is known about the potential role of arginase as a metabolic control point for arginine homeostasis in higher plants. The well-established role of NO in plant developmental and defense-related processes (Durner et al., *Curr. Opin. Plant Biol.* 2, 369-374 (1999); Wendehenne et al., *Trends Plant Sci.* 6:177-183 (2001); McDowell et al., *Trends Biochem. Sci.* 25:79-82 (2000)), together with the recent discovery of two arginine-utilizing plant NOSs (Chandok et al., *Cell* 113:469-482 (2003); Guo et al., *Science* 302:100-103

(2003)), provides a strong rationale for addressing this question. Most studies of plant arginase have focused on its role in mobilizing arginine as a nitrogen source during post-germinative growth (Splittstoesser et al., *Phytochemistry* 8:753-758 (1969); Kollöffel et al., *Plant Physiol.* 55:507-510 (1975); Wright et al., *Phytochemistry* 20:2641-2645 (1981); Boutin et al., *Eur. J. Biochem.* 127:237-243 (1982); Kang et al., *Plant Physiol* 93:1230-1234 (1990); Polacco et al., *Int. Rev. Cytol.* 145:65-103 (1993); Carvajal et al., *Phytochemistry* 41:373-376 (1996); Hwang et al., *Phytochemistry* 58:1015-1024 (2001)). Arginine can account for 50% of the nitrogen in seed protein, and up to 90% of the free nitrogen in vegetative tissues. In several plant species including soybean, broad bean, pumpkin, *Arabidopsis*, and loblolly pine, nitrogen mobilization during seedling development is correlated with large increases in arginase expression (Polacco et al., *Int. Rev. Cytol.* 145:65-103 (1993); Hwang et al., *Phytochemistry* 58:1015-1024 (2001); Todd et al., *Planta* 215:110-118 (2002)). Seedling arginase catalyzes the breakdown of a significant portion of the arginine pool to ornithine and urea. Ornithine can support the biosynthesis of polyamines, proline, and glutamate, whereas urea is further catabolized by urease to carbon dioxide and ammonium. The coordinate action of arginase and urease is thought to recycle ureanitrogen to meet the metabolic demands of developing seedlings (Polacco et al., *Int. Rev. Cytol.* 145:65-103 (1993); Zonia et al., *Plant Physiol.* 107:1097-1103 (1995)).

The molecular mechanisms by which arginase expression in plants is regulated by developmental or stress-related cues remain to be determined. A prerequisite for addressing this question is the unambiguous identification of genes that encode plant arginase. cDNAs encoding putative arginases has been reported for *Arabidopsis* (Krumpelman et al., *Plant Physiol.* 107:1479-1480 (1995)) (SEQ ID NO:07), soybean (Goldraij et al., *Plant Physiol.* 119:297-304 (1999)) (SEQ ID NO:10), and loblolly pine (Todd et al., *Plant Mol. Biol.* 45:555-565 (2001)) (SEQ ID NO:15), all of which are herein incorporated by reference. The arginase superfamily is composed of enzymes that hydrolyze various guanidino substrates to a one-carbon nitrogen-containing product (e.g., urea) and a second product that retains the quaternary nitrogen at the site of hydrolysis. The family includes arginase, agmatinase, proclavaminate amidino hydrolase (PAH), formiminoglutamase, as well as several uncharacterized sequences from archaea and eubacteria (Perozich et al., *Biochim. Biophys. Acta* 1382:23-37 (1998); Sekowska et al., *Microbiology-UK* 146:1815-1828 (2000)). Because the predicted sequences of plant arginases are more similar to agmatinase and other arginase-like enzymes than to non-plant arginases from vertebrates, fungi, and bacteria, it was suggested that plant genes annotated as arginase may encode agmatinase or another amidinohydrolase activity involved in the production of secondary metabolites (Perozich et al., *Biochim. Biophys. Acta* 1382:23-37 (1998); Sekowska et al., *Microbiology-UK* 146:1815-1828 (2000)). Although an *Arabidopsis* arginase cDNA can genetically complement an arginase-deficient yeast mutant (Krumpelman et al., *Plant Physiol.* 107:1479-1480 (1995)), direct enzymatic data is not available for a plant arginase gene.

To assess the role of arginase in arginine homeostasis in higher plants, we identified and characterized two arginase genes LeARG1 (SEQ ID NO:02) and LeARG2 (SEQ ID NO:01)) from tomato. Results demonstrate that, despite their phylogenetic similarity to agmatinases, the proteins encoded by LeARG1 (SEQ ID NO:02) and LeARG2 (SEQ ID NO:01) have robust amidinohydrolase activity against and high specificity for L-arginine. LeARG2 (SEQ ID NO:01) expression in leaves is strongly induced by wounding and, furthermore, that this induction is mediated by the plant stress signal jasmonic acid (JA). We also document induced expression of arginase in response to *Pseudomonas syringae*, the causal agent of bacterial speck disease. The bacterial toxin coronatine, which exerts its effects by activating the host JA signaling pathway, was both necessary and sufficient for arginase induction in *P. syringae*-infected plants. The potential role of stress-induced arginase in higher plants is discussed.

The present invention provides identification and characterization of two arginase-encoding genes (LeARG1 (SEQ ID NO:02) and LeARG2 (SEQ ID NO:01)) from tomato. Information obtained from the EST database, together with results from genomic DNA blot analysis, indicates that LeARG1 and LeARG2 are likely the arginase-encoding genes in tomato. RNA hybridization experiments with gene-specific probes showed that LeARG1 and LeARG2 are expressed to their highest levels in reproductive tissues of healthy plants. This observation agrees with previous studies showing that tomato ovaries and immature fruit contain relatively high levels of L-arginase activity (Heimer et al., FEBS Lett. 104:146-148 (1979); Teitel et al., Plant Growth Regul. 3:309-317 (1985); Alabadí et al., Plant Physiol. 118:323-328 (1998)). These studies have suggested that arginase expression in reproductive tissues of tomato plays a role in the production of polyamines that promote early fruit development.

Our analysis of the enzymatic properties of recombinant LeARG1 and LeARG2 showed that the substrate specificity, pH optima, and kinetic parameters of the two enzymes were virtually indistinguishable. These properties also are comparable to those reported for the native enzyme purified from tomato ovary (Alabadi et al., Plant Physiol. 112:1237-1244 (1996)) and other diverse plant sources (Boutin et al., Eur. J. Biochem. 127:237-243 (1982); Hwang et al., Phytochemistry 58:1015-1024 (2001); Jenkinson et al., Comp. Biochem. Physiol. B Biochem. Mol. Biol. 114:107-132 (1996)). The most notable biochemical feature of LeARGs was their high specificity for L-arginine. The clustering of plant arginase sequences into a distinct phylogenetic group (FIG. 1) suggests that this specificity is a general feature of plant ureohydrolases, and therefore that the major role of plant arginase is catabolism of L-arginine to urea and ornithine. Characterization of additional recombinant plant arginases is needed to verify this conclusion.

Phylogenetic analysis showed that LeARG1 (SEQ ID NO:02) and LeARG2 (SEQ ID NO:01) sequences are more similar to agmatinases than to non-plant arginases from vertebrates, fungi, and bacteria. Paradoxically, however, the plant enzymes are highly active against L-arginine but not agmatine or other guanidino substrates. These observations suggest that plant arginases define a distinct group of ureohydrolases whose evolutionary history is different from that of non-plant arginases. Sequence alignments showed that some amino acid residues involved in substrate binding are conserved between the plant and non-plant arginases, whereas others are not. For example, amino acids that interact with the Mn2+ cofactor and the guanidino moiety of the substrate are conserved in the plant proteins. However, residues in non-plant arginases that bind the a-amino and a-carboxyl groups of L-arginine, and impart specificity for the L-isomer, are not conserved in plant arginases. Presumably, the plant enzymes possess other structural features that provide specificity for L-arginine. In this context, it is noteworthy that the NO biosynthetic intermediate, NOHA, functions as a competitive inhibitor of both plant and non-plant arginases.

This observation provides indirect evidence that the structure of the active site of these two distinct groups of L-arginases is conserved. Elucidation of the three-dimensional structure of plant arginase is needed to determine more precisely the structural relationship between plant and non-plant arginases.

Our results support the hypothesis that L-arginase evolved from a broad specificity agmatinase or agmatinase-like enzyme (Sekowska et al., Microbiology-UK 146:1815-1828 (2000)). The sequence differences between plant and non-plant arginases lead us to suggest, however, that different mechanisms acted to progressively specify the plant and non-plant arginases for L-arginine. Such distinctions are likely to reflect differences in the physiological function of these enzymes in the plant and animal kingdoms. For example, a major role of mammalian arginase is the elimination of waste nitrogen via the urea cycle. In contrast to this detoxification function, the coordinate activity of arginase and urease in plants provides a mechanism to recycle urea-nitrogen in rapidly growing tissue (Todd et al., Planta 215:110-118 (2002); Zonia et al., Plant Physiol. 107:1097-1103 (1995)). A second significant difference between plant and non-plant arginases is their role in the synthesis of putrescine and higher polyamines. Polyamine biosynthesis in animals and fungi occurs primarily by the ornithine decarboxylase (ODC) pathway in which ornithine produced by arginase is converted directly to putrescine by ODC. Plants, by contrast, use both the ODC pathway and the arginine decarboxylase (ADC) pathway for polyamine synthesis. In the latter route, ADC converts arginine to agmatine, which is then metabolized to putrescine in a two-step process involving agmatine iminohydrolase and N-carbamoylputrescine amidohydrolase.

Considerations of the origin and fate of arginine in early evolution led to the proposal that the ODC pathway evolved later than the ADC pathway (Sekowska et al., Microbiology-UK 146:1815-1828 (2000)). If this is indeed the case, the evolution of plant arginase from a broad specificity ancestral enzyme may have been influenced by selective pressure for increased polyamine synthesis, or a metabolic function unrelated to polyamine production. It is interesting to note that some plants (e.g., *Arabidopsis thaliana*) have lost the ODC gene and therefore rely exclusively on the ADC pathway for polyamine biosynthesis (Hanfrey et al., Plant J. 27:551-560 (2001)). The relative contribution of the ODC pathway to polyamine production in plants such as tomato that retain both pathways is not known. If the ODC route is dispensable for polyamine synthesis, alternative functions for plant arginase need to be considered (see below).

Although LeARG1 and LeARG2 both function as L-arginases, the corresponding genes differ in their regulation. Of particular interest was the observation that LeARG2 expression and total arginase activity were strongly induced by wounding. Several lines of evidence indicate that this effect was dependent on the JA signal transduction pathway that mediates numerous stress-related plant responses. First, exogenous MeJA strongly elicited LeARG2 expression and a corresponding increase in arginase activity. Second, wound- and MeJA-induced expression of LeARG2 was abrogated in the jail mutant that lacks a functional JA signaling pathway. And third, the pathogen-derived toxin COR was necessary and sufficient for induced expression of LeARG2 in response to *P. syringae* infection. The ability of COR to function as a potent activator of JA-responsive genes in tomato (Zhao et al., Plant J. 36:485-499 (2003)) is consistent with the interpretation that induction of arginase in Pst DC3000-infected plants is mediated by the JA signaling pathway. A low level of LeARG1 expression also was observed in MeJA-treated leaves However, because the concentration of MeJA used in these experiments was likely well above the physiological level of JA in tomato leaves, increased expression of LeARG1 in these experiments may not be physiologically relevant. This interpretation is supported by the fact that LeARG1 was not induced by wounding, *P. syringae* infection, or treatment with moderate levels of COR. We thus conclude that LeARG2 is primarily responsible for stress-induced expression of arginase activity in tomato leaves. LeARG1 may have a more general role in arginine homeostasis, consistent with its expression in diverse tissue types. Preliminary experiments conducted with *A. thaliana* showed that one of the two arginase-encoding genes in this species (i.e., AtARG2) also is regulated by the JA signaling pathway. This finding suggests that stress-inducible arginase may be a general feature of higher plants.

The physiological function of wound- and JA-induced arginase in plants remains to be determined. In considering this question, we point out that stress-induced arginase in plants has striking parallels to the expression of mammalian arginases that are highly up-regulated in response to wound trauma and pathogen infection. Various inflammatory signals involved in regulating this response have been identified, including cytokines, interleukins, and prostaglandins (Morris, Annu. Rev. Nutr. 22:87-105 (2002); Cederbaum et al., Mol. Genet. Metab. Suppl 1:S38-44 (2004); Bronte et al., Trends Immunol. 24:302-306 (2003); Pauleau et al., J. Immunol. 172:7565-7573 (2004)). It is tempting to speculate that the function of stress-induced arginase may be conserved in diverse multicellular organisms. For example, polyamines produced by the arginase-ODC pathway may promote wound healing of plant tissues, in a manner analogous to the role of polyamines in tissue repair in animals (Cai et al., Neuron 35:711-719 (2002); Kämpfer et al., J. Invest. Dermatol. 121:1544-1551 (2003)). This idea is consistent with a large body of evidence indicating that wounding and JA induce the biosynthesis of polyamines and polyamine conjugates in diverse plant species (Chen et al., J. Plant Physiol. 143:119-121 (1994); Wang et al., Environ. Exp. Bot. 34:427-432 (1994); Lee et al., Plant Cell and Environ. 19:65-74 (1996); Lee et al., Phytochemistry 44:589-592 (1997); Imanishi et al., Plant Mol. Biol. 38:1101-1111 (1998); Mader et al., J. Plant Physiol. 154:79-88 (1999); Biondi et al., Plant Cell Rep. 19:691-697 (2000); Ogura et al., Z. Naturforsch. (C) 56:193-202 (2001); Biondi et al., J. Exp. Bot. 52:231-242 (2001); Keinanen et al., J. Agr Food Chem 49:3553-3558 (2001); Perez-Amador et al., Plant Physiol. 130:1454-1463 (2002); Walters et al., J. Exp. Bot. 53:747-756 (2002)), and the general role ascribed to polyamines in plant protection against biotic and abiotic stress (Bouchereau et al., Plant Sci. 140:103-125 (1999); Walters et al., Phytochemistry 64:97-107 (2003)).

Wound-induced plant arginase may play a role in protection against insects or other types of herbivores. Putrescine, for example, is a biosynthetic precursor of the potent antiherbivore toxin, nicotine (Imanishi et al., Plant Mol. Biol. 38:1101-1111 (1998); Biondi et al., J. Exp. Bot. 52:231-242 (2001)). Ornithine generated via the arginase reaction may be used for the synthesis of proline that is needed to produce hydroxy-proline-rich proteins (i.e., extensins). The expression of these defense-related glycoproteins, which reinforce the cell wall at sites of tissue damage, is known to be induced by wounding and JA (Zhou et al., Plant Mol. Biol. 20:5-17 (1992); Merkouropoulos et al., Planta 208:212-219 (1999)). In consideration of the metabolic demands faced by plants under attack by herbivores, another potential stress-related role for arginase is the production of urea. Herbivore-damaged tomato plants, for example, synthesize massive quantities of anti-nutritive proteinase inhibitors (PIs) that inhibit the feeding of lepidopteran caterpillars (Li et al., Proc. Natl. Acad. Sci. U.S.A. 99:6416-6421 (2002); Ryan et al., Biochem. Biophys. Acta 1477, 112-121 (2000)). The synthesis and accumulation of PIs requires the availability of large pools of nitrogen-rich amino acids. By analogy to the proposed role of arginase in nitrogen metabolism during postgerminative growth (Polacco et al., Int. Rev. Cytol. 145:65-103 (1993); Zonia et al., Plant Physiol. 107:1097-1103 (1995)), wound-induced catabolism of arginine to ammonium via the coordinate action of arginase and urease may provide a mechanism to divert urea-nitrogen into the production of amino acids that are used to support the synthesis of defensive PIs. It is also worth considering the possibility that plant arginase, like wound-inducible PIs, functions in the insect midgut in an anti-nutritive capacity. The pH optimum (~9.5), Km (~30 mM), and high stability of plant arginase suggest that the enzyme would be active within the alkaline and amino acid-rich environment of the insect midgut. By depleting the pool of arginine available for uptake into the intestine, wound-induced arginase may play a significant role in reducing the nutritional quality of damaged leaf tissue. Support for this hypothesis comes from our observation that jail tomato plants, which are defective in wound-induced arginase expression (FIG. 6), are severely compromised in defense against herbivore attack (Li et al., Plant Cell 16:126-143 (2004)).

Increasing evidence from mammalian systems indicates that arginase, by virtue of its ability to compete with NOS for a common substrate, plays an important role in attenuating NO production during pathogenesis (Vincendeau et al., Trends Parasitol. 19:9-12 (2003)). For example, trypanosomes can evade host defenses by stimulating the expression of macrophage arginase, which effectively inhibits NO production and NO-mediated trypanosome killing (Duleu et al., J. Immunol. 172:6298-6303 (2004)).

Similarly, an arginase expressed by *Helicobacter pylori* allows this human gastric pathogen to evade the host immune response by suppressing NO synthesis in activated macrophages (Gobert et al., Proc. Natl. Acad. Sci. U.S.A. 98:13844-13849 (2001)). With these examples in mind, our results suggest that induction of LeARG2 in response to Pst DC3000 infection may represent a virulence strategy of the pathogen to attenuate NO-mediated host defenses, which are well-documented in plants (Durner et al., Curr. Opin. Plant Biol. 2, 369-374 (1999); Wendehenne et al., Trends Plant Sci. 6:177-183 (2001); McDowell et al., Trends Biochem. Sci. 25:79-82 (2000)). This hypothesis is supported by the recent discovery of a pathogen-inducible plant NOS that uses arginine and NOHA as a substrate, and the demonstrated role of this protein in resistance of tomato to Pst DC3000 (Chandok et al., Cell 113:469-482 (2003); Chandok et al., Proc. Natl. Acad. Sci. U.S.A. 101:8239-8244 (2004)). We found that induction of arginase expression in Pst DC3000-infected plants was strictly dependent on COR. Previous studies showed that this toxin enhances the virulence of Pst DC3000 on tomato by coordinately activating the host JA signaling pathway for anti-herbivore defense and suppressing the salicylic acid (SA)-dependent pathway that is important for defense against Pst DC3000 (Zhao et al., Plant J. 36:485-499 (2003)). The results reported here therefore suggest that Pst DC3000 may use COR to suppress both the SA and NO pathways for plant defense. In considering potential interactions between the arginase and NOS pathways in plants, it is also interesting to note that the Ki for inhibition of tomato arginase by NOHA was more than 1000-fold lower than the Km for L-arginine, the enzyme's natural substrate. The ability of plant NOSs to utilize NOHA as a substrate (Chandok et al., Cell 113:469-482 (2003); Guo et al., Science 302:100-103 (2003)) suggests that this hydroxylated form of arginine may accumulate in plant tissues that are actively synthesizing NO. If this is the case, metabolic flux through the arginase pathway would likely be attenuated under conditions that promote NO synthesis.

I. Arginase (Arginase family) and Threonine Deaminase (Threonine Deaminase Family) Homologs in *Lycopersicon esculentum* (Tomato) and Other Species

*Lycopersicon esculentum* arginase and threonine deaminase sequences are also designated as family members according to homology determinations to known genes. It is understood that a large number of arginase and threonine deaminase nucleic acid sequences and peptide sequences have been reported, and can be identified by searches in genomic databased or sequencing genomes for sequence similarity to those that are known. No particular percentage of sequence similarity/homology is necessary for the nucleic acid sequence or peptide sequence to be considered within the arginase or threoneine deaminase family homology as long as the peptide expressed by the nucleic acid sequence functions to accomplish the catalytic functions of arginase or threonine deaminase and has some sequence homology. For purposes of illustraton, arginase and threonine deaminase family proteins were identified in the EST and genomic databases from a wide variety of monocots and dicots, including *Arabidopsis*, sorghum, barley, wheat, potato, soybean, grape, and loblolly pine etc., in addition to microorganisms, insects and animals. (FIGS. 9A-9J and Table 3).

SEQ ID NO:1.
*Lycopersicon esculentum* (tomato) LeARG2 cDNA
GenBank AY656838:
GTTCTTGTAGTAAACAAATATGAAGAGTGCTGGAAGTATGGGAATCAACT

ATATGCAGAAATTGCTAACGTCAAATGTTCCAAAAGAAGTAGTCAAAAGA

GGACAGGATCGTGTTGTAGAGGCATCTCTTACACTTATTCGTGAAAGAGC

AAAACTTAAGGGAGAGCTTGTTCGTGGACTTGGAGGTGCAGTAGCGTCAA

CGTCACTTCTTGGAATTCCTCTGGGACACAACTCTTCATTTCTCCAGGGC

CCTGCATTTGCTCCTCCTCTTATACGAGAGGCTATTTGGTGTGGCAGTAC

AAACTCCACAACTGAGGAAGGAAAAATATTAGATGATCAACGTGTCTTAA

CTGATGTTGGTGATCTGCCAGTACAAGAGTTACGAGACACAGGCATAGAT

GACGATAGGTTGATGAGTACAGTAAGTGAATCTGTCAAGCTAGTTATGGA

CGAGAATCCATTGCGCCCCTTGGTGTTAGGGGGTGATCACTCTATATCCT

ATCCTGTTGTAAGAGCTGTGTCTGAAAAGCTTGGAGGACCTGTTGATATC

CTTCACCTTGATGCTCATCCTGACATTTATGATGCATTTGAAGGAAACAA

ATACTCACATGCATCAAGCTTTGCACGAATAATGGAGGGTGGTTATGCTC

GACGCCTTTTGCAAGTTGGAATTAGATCAATTAATCTAGAAGGTCGAGAA

CAAGGAAAAGGTTTGGTGTGGAGCAATATGAAATGCGAACATTTTCCAG

AGACAGACAATTTTTGGAGAATCTGAAACTTGGTGAAGGTGTAAAGGGCG

TGTATATATCCGTGGATGTTGACTGTTTGGATCCAGCATTTGCTCCTGGA

GTATCTCATTTTGAGTCAGGCGGTCTCTCGTTCCGCGATGTTCTAAACAT

ACTGCATAACCTTCAAGGTGATATCGTTGGTGCTGATGTCGTTGAGTACA

-continued

ACCCACAGCGTGATACTGCTGATGGCATGACTGCAATGGTTGCTGCGAAG

CTGGTAAGAGAACTTGCTGCCAAGATGTCCAAGTGACCTGCAGTAATTTT

CAATTTTAACAAGCAAGAAGTACCATGTATCCTATTAGTGTACTCATCTT

TATGCGAAAATAAGTGTTTATTCACATTAGGTAGGTCTGGCAGATGCTCA

GTTTCCTATGGCAAGGGGGATTGGGATTATCTGTAAACTTGCCTCCCAAA

ATAAGCTAGTATATTTGCAGTTCCTTATGAGTAACCTGTTGTTGTAAGTG

ACACTTGTATCATTTGGTATGGAGTTTGTTGTGTATGGATGTTTTGAATC

TTAAAAAAAAAAAAAAAAAAAAAAAAAAAAAAAAAAAAAAAAAAAAAAAA

AAAAAAAAA

SEQ ID NO:2.
Lycopersicon esculentum (tomato) LeARG1 cDNA
GenBank AY656837:
GCACGAGGGTCCCCTTCACAAGAGAAATGGATTGGCTTAATCAGTCGGTG

ATTACGTGTAAATTGTGCTAATCTCCGTTGCCTAATAACAATATTTCCAT

TTTCATACTCCACCCGCTGCAAGCACCAAATCCCATTATATTACTACTAA

AAACGACTGCATGTCTTCTTCTTTTTTAAACTCAGCGATTGCCTTCTTTT

TTTGCTCTCATCACTCTTTCTTGCAGTTGTAGGATAATCAGAATAAACAA

ATATGAGGAGTGCTGGAAGAATGGGAATCCATTATATGCAGAAATTGCAC

GCGTCAAATGTTCCAAAAGAATTGGTGGAAAAAGGACAGAATCGTGTTAT

AGAGGCATCTCTTACACTTATTCGTGAAAGAGCAAAACTTAAGGGAGAGC

TTGTTCGTGCTCTTGGAGGTGCTGTAGCCTCAACGTCTCTTCTTGGAGTT

CCTCTGGGACATAACTCTTCATTTCTCCAGGGGCCAGCATTTGCTCCTCC

TCGTATACGAGAGGCTATGTGGTGTGGCAGTACAAACTCTACAACTGAGG

AAGGAAAAGAATTAGATGATCCACGCATCTTAACTGATGTTGGTGATGTG

CCTGTGCAAGAGTTACGAGATGCAGGTGTAGATGATGATAGGTTAATGAG

TATCATAAGCGAATCTGTCAAGCTAGTTATGGAAGAGAATCCATTGCGCC

CCTTGGTGTTAGGGGGTGATCACTCTATATCCTATCCTGTTGTAAGAGCT

GTGTCTGAAAAGCTTGGAGGGCCTATTGATATCCTTCACCTTGATGCTCA

TCCTGACATTTATCATGCCTTTGAAGGAAACAAATACTCACATGCATCAA

GCTTTGCACGGATAATGGAGGTGGTTATGCTCGACGGCTTTTGCAAGTG

GGAATTAGATCAATTAATAAAGAAGGTCGAGAACAAGGAAAAAGGTTCGG

TGTGGAGCAATATGAAATGCGAACATTTTCCCAAGACCGACAATTTTTGG

AGAATCTGAAACTTGGCGAAGGTGTGAAGGGCGTGTATATCTCAGTGGAT

GTTGACTGTATGGATCCAGCATTTGCTCCTGGAGTATCTCATATAGAACC

AGGAGGTCTCTCTTTCCGCGATGTTCTAAACATACTGCATAACCTTCAAG

CTGATGTTGTTGGTGCTGATGTGGTTGAGTTCAACCCGCAGCGTGATACT

GTTGATGGCATGACTGCAATGGTTGCTGCGAAGCTGGTAAGAGAACTTAC

TGCCAAGATATCCAAGTGACCTGCAGTAATTTCTAAAATTATGAAGGAAG

AATTACCATGCATCCAATAGAGACCACTAGATTTGTACTCATCTTTACTG

GGGAGGTTTAACAGAGAATAAGCACCAAAATGAAGTGTTTATTCACCTTA

TTGTAACTCTAAAACTAAAAGCTATATTTGCAGTTCATTATGAGGACCCT

GTGATTCTTATAATCTTTTAAGTGGTGCAAAAAAAAAAAAAAAAAAAAAA

AAAAAAA

SEQ ID NO:3.
Lycopersicon esculentum (tomato) BT013286:
TCCCCTTCACAAGAGAAATGGATTGGCTTAATCAGTCGGTGATTACGTGT

AAATTGTGCTAATCTCCGTTGCCTAATAACAATATTTCCATTTTCATACT

CCACCCGCTGCAAGCACCAAATCCCATTATATTACTACTAAAAACGACTG

CATGTCTTCTTCTTTTTAAACTCAGCGATTGCCTTCTTTTTTGCTCTC

ATCACTCTTTCTTGCAGTTGTAGGATAATCAGAATAAACAAATATGAGGA

GTGCTGGAAGAATGGGAATCCATTATATGCAGAAATTGCACGCGTCAAAT

GTTCCAAAAGAATTGGTGGAAAAAGGACAGAATCGTGTTATAGAGGCATC

TCTTACACTTATTCGTGAAAGAGCAAAACTTAAGGGAGAGCTTGTTCGTG

CTCTTGGAGGTGCTGTAGCCTCAACGTCTCTTCTTGGAGTTCCTCTGGGA

CATAACTCTTCATTTCTCCAGGGGCCAGCATTTGCTCCTCCTCGTATACG

AGAGGCTATGTGGTGTGGCAGTACAAACTCTACAACTGAGGAAGGAAAAG

AATTAGATGATCCACGCATCTTAACTGATGTTGGTGATGTGCCTGTGCAA

GAGTTACGAGATGCAGGTGTAGATGATGATAGGTTAATGAGTATCATAAG

CGAATCTGTCAAGCTAGTTATGGAAGAGAATCCATTGCGCCCCTTGGTGT

TAGGGGGTGATCACTCTATATCCTATCCTGTTGTAAGAGCTGTGTCTGAA

AAGCTTGGAGGGCCTATTGATATCCTTCACCTTGATGCTCATCCTGACAT

TTATCATGCCTTTGAAGGAAACAAATACTCACATGCATCAAGCTTTGCAC

GGATAATGGAGGGTGGTTATGCTCGACGGCTTTTGCAAGTGGGAATTAGA

TCAATTAATAAAGAAGGTCGAGAACAAGGAAAAAGGTTCGGTGTGGAGCA

ATATGAAATGCGAACATTTTCCCAAGACCGACAATTTTTGGAGAATCTGA

AACTTGGCGAAGGTGTGAAGGGCGTGTATATCTCAGTGGATGTTGACTGT

ATGGATCCAGCATTTGCTCCTGGAGTATCTCATATAGAACCAGGAGGTCT

CTCTTTCCGCGATGTTCTAAACATACTGCATAACCTTCAAGCTGATGTTG

TTGGTGCTGATGTGGTTGAGTTCAACCCGCAGCGTGATACTGTTGATGGC

ATGACTGCAATGGTTGCTGCGAAGCTGGTAAGAGAACTTACTGCCAAGAT

ATCCAAGTGACCTGCAGTAATTTCTAAAATTATGAAGGAAGAATTACCAT

GCATCCAATAGAGACCACTAGATTTGTACTCATCTTTACTGGGGAGGTTT

AACAGAGAATAAGCACCAAAATGAAGTGTTTATTCACCTTATTGTAACTC

TAAAACTAAAAGCTATATTTGCAGTTCATTATGAGGACCCTGTGATTCTT

ATAATCTTTTAAGTGGTGCAAAAAAAAAAAAAAAAAAAAAAAAAA

SEQ ID NO:4.
Lycopersicon esculentum (tomato) TIGR unigene
TC142949:
CTTCATTTCTTGTGTAGTCACTTCCTCCTTTATTCTTTGTTTACTTTAAT

TTCCAGCTCTTTCGGTTTCTGCATTTTTTTTTATATATTTTTCCTTTTTG

TTGTGTTGAATCAGAGTAAACAAATATGAAGAGTGCTGGAAGTATGGGAA

TCAACTATATGCAGAAATTGCTAACGTCAAATGTTCCAAAAGAAGTAGTC

AAAAGAGGACAGGATCGTGTTGTAGAGGCATCTCTTACACTTATTCGTGA

AAGAGCAAAACTTAAGGGAGAGCTTGTTCGTGGACTTGGAGGTGCAGTAG

CGTCAACGTCACTTCTTGGAATTCCTCTGGGACACAACTCTTCATTTCTC

```
CAGGGCCCTGCATTTGCTCCTCCTCTTATACGAGAGGCTATTTGGTGTGG
CAGTACAAACTCCACAACTGAGGAAGGAAAAATATTAGATGATCAACGTG
TCTTAACTGATGTTGGTGATCTGCCAGTACAAGAGTTACGAGACACAGGC
ATAGATGACGATAGGTTGATGAGTACAGTAAGTGAATCTGTCAAGCTAGT
TATGGACGAGAATCCATTGCGCCCCTTGGTGTTAGGGGGTGATCACTCTA
TATCCTATCCTGTTGTAAGAGCTGTGTCTGAAAAGCTTGGAGGACCTGTT
GATATCCTTCACCTTGATGCTCATCCTGACATTTATGATGCATTTGAAGG
AAACAAATACTCACATGCATCAAGCTTTGCACGAATAATGGAGGGTGGTT
ATGCTCGACGCCTTTTGCAAGTTGGAATTAGATCAATTAATCTAGAAGGT
CGAGAACAAGGAAAAAGGTTTGGTGTGGAGCAATATGAAATGCGAACATT
TTCCAGAGACAGACAATTTTTGGAGAATCTGAAACTTGGTGAAGGTGTAA
AGGGCGTGTATATCCGTGGATGTTGACTGTTTGGATCCAGCATTTGCT
CCTGGAGTATCTCATTTTGAGTCAGGCGGTCTCTCGTTCCGCGATGTTCT
AAACATACTGCATAACCTTCAAGGTGATATCGTTGGTGCTGATGTCGTTG
AGTACAACCCACAGCGTGATAGTGCTGATGGCATGACTGCAATGGTTGCT
GCGAAGCTGGTAAGAGAACTTGCTGCCAAGATGTCCAAGTGACCTGCAGT
AATTTTCAATTTTAACAAGCAAGAAGTACCATGTATCCTATTAGTGTACT
CATCTTTATGCGAAAATAAGTGTTTATTCACATTAGGTAGGTCTGGCAGA
TGCTCAGTTTCCTATGGCAAGGGGGATTGGGATTATCTGTAAACTTGCCT
CCCAAAATAAGCTAGTATATTTGCAGTTCCTTATGAGTAACCTGTTGTTG
TAAGTGACACTTGTATCATTTGGTATGGAGTTTGTTGTGTATGG
```

SEQ ID NO:5.
*Solanum tuberosum* TIGR unigene TC94228 (Genbank EST BM403790):
```
TACTAAAAACGACTGCATGTCTTCTCTTCTTTAcCTCTATCTATTCAACA
ACTCTTTCTTAAACTCTGCGATTGCCTTCTTTTTTGCTCTCATCACTCTT
TCTTGCAGTTGTAGGATAATCAGAATAAACAAATATGAAGAATGCTGGAA
GAATGGGAATCCATTATATGCAGAAATTGCACGCGTCAAATGTTCCAAAA
GAATTGGTGGAAAAGGACAGAATCGTGTTATAGAGGCATCTCTTACACT
TATTCGTGAAAGAGCAAACTTAAGGGAGAGCTTGTCCGTGCTCTTGGAG
GTGCTGTAGCCTCAACGTCTCTTCTTGGAGTTCCTCTGGGACATAACTCC
TCATTTCTCCAGGGGCCAGCATTTGCTCCTCCTCGTATACGAGAGGCTAT
GTGGTGTGGCAGTACAAACTCTACAACTGAGGAAGGAAAAGAATTAGATG
ATCCACGCATCTTAACTGATGTTGGTGATGTGCCTGTTCAAGAGTTACGA
GATGCAGGCGTAGATGATGATAGGTTGATGAGTATCATAAGTGAATCTGT
CAAGCTAGTTATGGAGGAGAATCCATTGCGCCCCTTGGTGTTAGGGGGTG
ATCACTCTATATCCTATCCTGTTGTAAGAGCTGTGTCTGAAAAGCTTGGA
GGTCCTATTGATATCCTTCACCTTGATGCTCATCCTGACATTTATGATGC
ATTTGAAGGAAACAAATACTCACATGCATCAAGCTTTGCACGAATAATGG
AGGGTGGTTATGCTCGACGGCTTTTGCAAGTGGGAATTAGATCAATTAAT
AAAGAAGGTCGAGAACAAGGAAAAAGGTTCGGTGTGGAGCAATATGAAAT
GCAAACATATTCCCAAGACCGACAATTTTTGGAGAATCTGAAACTTGGCG
AAGGTGTGAAGGGCGTGTATATCTCCGTGGATGTTGACTGTATGGATCCA
GCATTTGCTCCTGGAGTATCTCATATAGAACCAGGAGGTCTCTCTTTCCG
TGATGTTCTAAACATACTGCATAACCTTCAAGCTGATGTTGTTGGTGCTG
ATGTCGTTGAGTTCAACCCACAGCGTGATACTGTTGATGGCATGACTGCA
ATGGTTGCTGCGAAGCTGGTAAGAGAACTTACTGCCAAGATATCCAAGTG
ACCTGCAGGAATTCTGAATTTATCAAGGAAAGAAGAAGTACCATGCATCC
TATAGAGGACTGCTAGATTTGTACTCATCAAGTTTAACAGAGAATAAGCA
CCAAAGGAAGTGTTTATTCACCTTATTGTAACTCTGAAACTAAAAGCATA
CTAGGACTTAAAATTTAATTA
```

SEQ ID NO:6.
*Lotus corniculatus* var. *japonicus* (Lotus japonicus) TIGR unigene TC8390 (Genbank EST BP037794):
```
TGGGTACGGGCCCCCCTTCAAGTCTAGTGTCATTAATTTCTACAGGCAGA
GAATTGGTGAGATCAAACAATGTTTCCTAAAGGAATGTCAACTATAGCCC
GCAGAGGCATCCATTACATGCAGGAAATACAGGCAGCAAAAGTATCTCCT
GCTTCCCTAGAGCAAGGCCAAAAGGGTGTGATAGAAGCTTCCCTAGCACT
TATTCGAGAAAATGCAAAGCTCAAGGGAGAACTTGTGCGTGCTTATGGAG
GCGCCGTAGCAACTTCATCTCTTTTGGGAGTTCCTTTGGGACACAATTCT
TCATTCCTTCAAGGGCCTGCATTTGCACCTCCTCACATTAGGGAAGCTAT
TTGGTGTGGCAGCACAAACTCAACAACTGAAGAAGGAAAGGATTTAAGGG
ATCCACGAGTGCTAGCTAGTGTTGGAGATCTTGCTGTCCAAGAAATTAGA
GAGTGTGGAGTAGATGATCATCGATTGATGAATGTAGTTAGTGATGCTGT
CAAGTTAGTCATGGAAGAGGATCCATTACGTCCCTTGGTTTTAGGTGGAG
ATCACTCAATAACATATCCAATTGTTAGAGCTATCTCTGAGAAGCTTGGA
GGACCAATTGACCTTCTTCATTTTGATGCACATCCTGATCTCTATCATGA
ATTTGAAGGAAAACTTTTATTCCCATGCTTCTTCGTTTGCTCGAATCATG
GAGGGCGGCTATGCTCGTCGACTCTTGCAGGTTGGTATAAGATCAATAAA
TTATGAAGGGCGTGAACAAGCAAAAAATTTGGAGTAGAGCAATATGAAA
TGAGAACATATTCAAAGGATCGCCCCTTTTTGGAGAACCTGAAACTAGGA
GAAGGTGTTAAAGGCGTTTACATCTCAATAGATGTGGATTGTCTTGATCC
AGGGTATGCACCAGGAGTGTCTCACCATGAATCAGGAGGTCTTTCTTTCC
GAGATGTTATGAACGTCCTGCAAAATCTTCAAGGCGATATTGTTGGTGGG
GATGTGGTAGAGTACAACCCACAACGTGATACTGCTGATGATATGACCGC
TATGGTAGCTGCTAAGTTTGTAAGAGAACTTGCTGCAAAGATGTCAAAAT
GATGATGAATGTCTAGCTTTTTCAGAGTGACATTTAGTTTTCTCTAAGTT
TTATTTGAAGTATCAATAAAGGAGTGAGTATAGGTGTACCGTACGTGTAC
GAGTGAGTTCTTTAGCCTGAATGAAAACAAGCTTGCGCATCTTCTTTTAA
TGCATGTACGCCAGAAACCATAAGATCAGAACTTGTAATTCTGGTGATTG
GTTTCACTTGTGCCGTTGTGCGCCCATCATTTGCCATGTAACTTGAATTT
CTGAACAAGAA
```

SEQ ID NO:7.
Arabidopsis thaliana arginase mRNA, Krumpelman,
ACCESSION U15019:
GCGGCCGCCAGTGTGAGTAATTTAGAAACTCCGAGTGGCCGAAACAGAGA

TTTCGCAGAGGAACCATCACTGATTGTGTCACCGAACCATTGATCTTCAA

GTTCCGATCCAATTTCAGATATGTCGAGGATTATTGGTAGAAAAGGGATT

AACTATATCCATAGACTAAATTCTGCGTCGTTCACGAGCGTATCTGCTTC

TTCAATCGAGAAAGGGCAAAATCGTGTGATTGATGCTTCGTTAACTCTTA

TTCGTGAAAGGGCAAAACTCAAAGGAGAGTTAGTGCGTCTTTTAGGTGGA

GCTAAAGCTTCAACATCTCTTCTTGGTGTACCACTTGGTCACAACTCTTC

TTTTCTTCAAGGTCCTGCTTTTGCTCCTCCTCGTATTCGAGAAGCTATTT

GGTGTGGTAGCACAAACTCTGCCACTGAAGAAGGGAAGGAGTTGAAGGAT

CCACGGGTTCTAACTGATGTTGGGGATGTTCCGGTACAAGAGATTAGAGA

TTGTGGGGTTGATGATGATAGACTGATGAATGTCATAAGTGAATCTGTGA

AGTTGGTGATGGAAGAGGAACCATTGCGTCCGTTGGTCTTAGGTGGAGAC

CATTCCATATCTTATCCTGTTGTGAGAGCGGTTTCTGAGAAGCTTGGAGG

GCCTGTGGACATTCTTCATCTTGATGCACATCCGGATATATATGACTGTT

TTGAAGGAAATAAGTACTCTCATGCATCTTCTTTTGCTCGTATCATGGAA

GGTGGCTATGCGCGTAGGCTTTTACAGGTTGGGATCAGATCGATAAACCA

GGAAGGACGGGAACAAGGCAAGAGGTTTGGAGTAGAACAGTATGAGATGC

GAACCTTCTCGAAAGATCGCCCAATGTTGGAAAATCTGAAATTAGGGGAA

GGAGTGAAGGGGTATACATCTCGATAGACGTTGACTGTCTCGATCCGGC

ATTTGCACCTGGAGTGTCGCATATCGAACCAGGAGGTCTCTCTTTCCGTG

ACGTCCTTAACATCTTACACAACCTTCAGGCAGATGTTGTCGGGGCTGAC

GTTGTCGAGTTCAACCCGCAGCGTGATACTGTTGACGGCATGACAGCAAT

GGTTGCAGCTAAGCTTGTTAGAGAATTAGCTGCGAAAATCTCGAAATGAA

ACAGAATGGTAATTTTGGAGTTTGTTTTTGTTATGTTTCATCGTGCAAG

TTTGTAACATTCATATAGGTACTTGAATGCAATAAGTCTGGCTCATAGAC

GGAGTATCAAACAAACATAATATGAATTCTGATCTAAGGCTATAAAATCA

ATGTTCATATGCCTAAAAAAAAAAAAAAAAAAAACTAAATTACTCACACTGG

CGGCCGC

SEQ ID NO:8.
Arabidopsis thaliana 1 AY052276:
ACCGAGAAAACTCCGAGTGGCCGAAACAGAGATTTCGCAGAGGAACCATC

ACTGATTGTGTCACCGAACCATTGATCTTCAAGTTCCGATCCAATTTCAG

ATATGTCGAGGATTATTGGTAGAAAAGGGATTAACTATATCCATAGACTA

AATTCTGCGTCGTTCACGAGCGTATCTGCTTCTTCAATCGAGAAAGGGCA

AAATCGCGTGATTGATGCTTCGTTAACTCTTATTCGTGAAAGGGCAAAAC

TCAAAGGAGAGTTAGTGCGTCTTTTAGGTGGAGCTAAAGCTTCAACATCT

CTTCTTGGTGTACCACTTGGTCACAACTCTTCTTTTCTTCAAGGTCCTGC

TTTTGCTCCTCCTCGTATTCGAGAAGCTATTTGGTGTGGTAGCACAAACT

CTGCCACTGAAGAAGGGAAGGAGTTGAAGGATCCACGGGTTCTAACTGAT

GTTGGGGATGTTCCGGTACAAGAGATTAGAGATTGTGGGGTTGATGATGA

TAGACTGATGAATGTCATAAGTGAATCTGTGAAGTTGGTGATGGAAGAGG

AACCATTGCGTCCGTTGGTCTTAGGTGGAGACCATTCCATATCTTATCCT

GTTGTGAGAGCGGTTTCTGAGAAGCTTGGAGGGCCTGTGGACATTCTTCA

TCTTGATGCACATCCGGATATATATGACTGTTTTGAAGGAAATAAGTACT

CTCATGCATCTTCTTTTGCTCGTATCATGGAAGGTGGCTATGCGCGTAGG

CTTTTACAGGTTGGGATCAGATCGATAAACCAGGAAGGACGGGAACAAGG

CAAGAGGTTTGGAGTAGAACAGTATGAGATGCGAACCTTCTCGAAAGATC

GCCCAATGTTGGAAAATCTGAAATTAGGGGAAGGAGTGAAGGGGTATAC

ATCTCGATAGACGTTGACTGTCTCGATCCGGCATTTGCACCTGGAGTGTC

GCATATCGAACCAGGAGGTCTCTCTTTCCGTGACGTCCTTAACATCTTAC

ACAACCTTCAGGCAGATGTTGTCGGGGCTGACGTTGTCGAGTTCAACCCG

CAGCGTGATACTGTTGACGGCATGACAGCAATGGTTGCAGCTAAGCTTGT

TAGAGAATTAGCTGCGAAAATCTCGAAATGAAACAGAATGGTAATTTTGG

AGTTTGTTTTTGTTATGTTTCATCGTGCAAGTTTGTAACATTCATATAG

GTTCTTGAATGCAATAAGTCTGGCTCCATAGACGGAGTATCAAACAAACA

TAATATGAATTCTGATCTAAGGCTATAAAATCAATGTTCATATGCG

SEQ ID NO:9.
Arabidopsis thaliana 2 putative arginase AY087307:
ACTTATACCTCACTGACTTACTACAAATCAGATATGTGGAAGATTGGGCA

GAGAGGAGTTCCCTATTTCCAGAGACTCATTGCTGCGCCGTTCACGACCT

TGCGGTCCTTGCCAACTTCTTTGGTCGAGACAGGGCAGAACCGTGTCATT

GATGCTTCGTTAACTCTCATCCGTGAAAGGGCAAAACTCAAAGGAGAGTT

AGTGCGACTCATAGGAGGAGCAAAAGCTACAACAGCTCTTCTTGGAGTAC

CACTTGGTCACAACTCTTCTTTTCTTGAAGGCCCAGCCTTGGCTCCTACT

CATGTAAGGGAAGCTATTTGGTGTGGTAGTACAAACTCCACCACTGAAGA

AGGGAAGGAGCTAAAAGATCCACGTGTTCTAAGTGATGTTGGGGATATTC

CGGTACAAGAGATTAGAGAAATGGGGGTTGATGATGATAGACTTATGAAT

GTAGTAAGTGAATCTGTGAAGCTGGTTATGGAAGAGGAACCATTGCGCCC

GCTGGTCATAGGTGGAGACCATTCCATATCTTATCCTGTTGTGAGAGCTG

TTTCGGAGAAACTTGGAGGACCCGTGGATATTCTTCATCTTGATGCACAT

CCCGATATATATGACCGTTTTGAAGGCAATTATTACTCTCATGCATCTTC

TTTTGCTCGTATCATGGAAGGTGGCTATGCGCGGCGGCTTTTACAGGTTG

GGATCAGATCCATAAACAAAGAAGGACGGGAACAAGGCAAGAGGTTTGGA

GTAGAACAGTATGAGATGCGAACCTTCTCAAAAGATCGCCAAATGTTGGA

AAACTTGAAACTAGGGGAAGGAGTGAAGGCGTGTATATCTCGATCGATG

TTGACTGTCTCGATCCGGGATTCGCGCACGGAGTGTCCCACTTCGAACCA

GGAGGTCTTTCTTTCCGAGACGTCCTTAACATATTACACAACCTTCAGGG

AGATTTGGTGGGGCTGATGTTGTTGGGTACAATCCACAGCGTGATACCG

CTGATGACATGACGGCAATGGTCGCGGCTAAGTTTGTTAGAGAGCTAGCC

GCAAAAATGTCAAAATGAATTTAAATGGTACTTTGGAGTTTAATCGTTGA

AGCTTGTAATATGCAATAAGTGTGGTCTCATAGACATGGTATCGAATAAG

CTTAATATCAATTGGGTTTTTAGGCCCAAATATCAATGTATAATTTATTA

AATTTATGATAAGATGCATTGTAATAAGTTGTAAAAATAATTTATCATATT

GCAATATATGTAAACATTAATTTAGC

SEQ ID NO:10.
*Glycine max* (soybean) AF035671 Goldraij, arginase
(pAG1) mRNA, complete cds, ACCESSION AF035671:
GTGACCCCAATATACTTAGCCATATCTTTACTTCCCAAAACTTGCTCTAC

ATGAGTTTCCTTCGTTCTTTTGCAAGAAACAAGGATATATCAAAAGTAGG

ACGCAGAGGTATCCATTGCATGCAGAAACTATGTGCAGAAAAATATCTC

CTGATTCACTAGAGAAGGCCCAAAATCGTGTGATAGATGCTGCACTCACA

CTTGTTCGAGAAAATACAGGCTTAAGAAAGAACTTGTGTCATAGTTTGGG

AGGTGCTGTAGCAACTTCAACTCTTCTTGGAGTTCCTTTGGGTCATAATT

CATCGTTTCTTGAAGGGCCTGCATTTGCACCTCCTTTCATTAGGGAAGGT

ATTTGGTGTGGTAGCGCAAACTCCACAACTGAAGAAGGAAAGGATTTAAA

GGACTTGCGAATAATGGTTGATGTTGGTGATATCCCTATTCAAGAAATGC

GAGATTGTGGGATAGGAGATGAGAGACTCATGAAAGTTGTTAGTGATTCT

GTCAAACTAGTGATGGAAGAGGATCCATTACGTCCCTTAATTTTGGGTGG

TGATCCATCAATCTCATATCCAGTTGTCAGAGCCATATCTGAGAAGCTTG

GGGGACCAGTTGATGTTCTTCATTTTGATGCACATCCTGATCTCTATGAT

GAATTTGAAGGAAATTATTATTCGCACGCTTCTTCTTTTGCTCGAATCAT

GGAGGGTGGTTATGCTCGTCGACTCTTGCAGGTCGGTATAAGATCAATAA

ACAAAGAAGGGCGTGAACAAGCCAAAAAGTTCGGGGTAGAGCAGTTTGAA

ATGCGACATTTTTCGAAAGATCGTCCATTTTTGGAAAACCTGAATCTAGG

AGAAGGTGCTAAAGGAGTATACATTTCAATCGATGTGGATTGTCTTGATC

CAGGGTATGCTGTAGGAGTGTCCCACTATGAATCAGGAGGTCTTTCTTTC

AGGGATGTTATGAACATGCTGCAAAATCTCAAAGGTGACATTGTTGGTGG

AGACGTGGTTGAATACAACCCACAACGTGAACCTCCTGATCGTATGACTG

CCATGGTAGCTGCTAAGTTTGTGAGAGAACTCGCTGCAAAGATGTCAAAA

TGATAACTATTAATTCTGCCTCGTGTGTGTGACATTTAGTTTACTTCAAT

GCACTCAACTTTTCAATTTATAGTGTTGTTGTTATGAATAAATAATACAT

GCACTATTACCCTGTTTACACTAACAGTGTAAAGATGATGTATGTGTATA

AGACTAAGTTTTGTGGTGTTCTATTAGAAGTATTAATCTTGTTAAAAAAA

AATGTATTTGTCATGTGAAGGAAA

SEQ ID NO:11.
*Glycine max* (soybean) TIGR unigene TC181483
(Genbank EST BM308429):
TTCTCTTTCAAGTTCCAAGAAATGTCAATTATAACACGCAGAGGCATCCG

TTACATGCCAAGACTAGATGCAGCAAAAGTATCTGCTGCTTTGCTAGAAA

AAGGCCAAAATCGTGTCATAGATGCTTCACTTACACTTATTCGAGAAAGA

GCAAAGCTTAAGGGAGAACTTGTGCGTGCTTTGGGAGGTGCTAAAGCAAC

TTCAACTCTTCTTGGAGTTCCTTTGGGACATAATTCATCGTTCCTTCAAG

GGCCTGCATTTGCACCTCCTCGCATTAGGGAGGCCATTTGGTGTGGTAGC

ACCAACTCAACAACTGAAGAAGGCAAGGAATTACAAGATGCACGAGTGCT

AACTGATGTTGGTGATGTTCCTATCCAGGAAATTCGAGATTGTGGGGTAG

ATGATCACAGATTAATGAATGTAATTGGTGAATCTGTAAAGTTAGTGATG

GAGGAGGATCCATTATGTCCCTTAGTTTTAGGCGGTGATCACTCAATATC

ATTTCCAGTTATCAGAGCTGTCTCTGAGAAGCTTGGAGGACCAGTTGATG

TTCTTCATCTTGATGCGCATCCTGAT

SEQ ID NO:12.
*Glycine max* (soybean) TIGR unigene TC215865
(Genbank EST AF035671):
ACGAGCAGAAGTGACCCCAATATACTTAGCCATATCTTTACTTCCCAAAA

CTTGCTCTACAATGAGTTTCCTTCGTTCTTTTGCAAGAACAAGGATATAT

CAAAAGTAGGACGCAGAGGTATCCATTGCATGCAGAAACTATGTGCAGAA

AAATATCTCCTGATTCACTAGAGAAGGCCCAAAATCGTGTGATAGATGC

TGCACTCACACTTGTTCGAGAAAATACAAGGCTTAAGAAAGAACTTGTGC

ATAGTTTGGGAGGTGCTGTAGCAACTTCAACTCTTCTTGGAGTTCCTTTG

GGTCATAATTCATCGTTTCTTGAAGGGCCTGCATTTGCACCTCCTTTCAT

TAGGGAAGGTATTTGGTGTGGTAGCGCAAACTCCACAACTGAAGAAGGAA

AGGATTTAAAGGACTTGCGAATAATGGTTGATGTTGGTGATATCCCTATT

CAAGAAATGCGAGATTGTGGGATAGGAGATGAGAGACTCATGAAAGTTGT

TAGTGATTCTGTCAAACTAGTGATGGAAGAGGATCCATTACGTCCCTTAA

TTTTGGGTGGTGATCACTCAATCTCATATCCAGTTGTCAGAGCCATATCT

GAGAAGCTTGGGGACCAGTTGATGTTCTTCATTTTGATGCACATCCTGA

TCTCTATGATGAATTTGAAGGAAATTATTATTCGCACGCTTCTTCTTTTG

CTCGAATCATGGAGGGTGGTTATGCTCGTCGACTCTTGCAGGTCGGTATA

AGATCAATAAACAAAGAAGGGCGTGAACAAGCCAAAAAGTTCGGGGTAGA

GCAGTTTGAAATGCGACATTTTTCGAAAGATCGTCCATTTTTGGAAAACC

TGAATCTAGGAGAAGGTGCTAAAGGAGTATACATTTCAATCGATGTGGAT

TGTCTTGATCCAGGGTATGCTGTAGGAGTGTCCCACTATGAATCAGGAGG

TCTTTCTTTCAGGGATGTTATGAACATGCTGCAAAATCTCAAAGGTGACA

TTGTTGGTGGAGACGTGGTTGAATACAACCCACAACGTGACACTCCTGAT

CGTATGACTGCCATGGTAGCTGCTAAGTTTGTGAGAGAACTCGCTGCAAA

GATGTCAAAATGATAACTATTAATTCTGCCTCGTGTGTGTGACATTTAGT

TTACTTCAATGCACTCAACTTTTCAATTTATAGTGTTGTTGTTATGAATA

AATAATACATGCACTATTACCCTGTTTACACTAACAGTGTAAAGATGATG

TATGTGTATAAGACTAAGTTTTGTGGTGTTCTATTAGAAGTATTAATCTT

GTTAAAAAAAAATGTATTTGTCATGTGAAGGAAA

SEQ ID NO:13.
*Glycine max* (soybean) TIGR unigene TC219468
(Genbank EST CF807934) (Genbank EST BM308429):
GACGGTTTCCGCTGTTCTCTTTTAAGTTCCAAGAAATGTCAATTATAACA

CGCAGAGGCATCCGTTACATGCCAAGACTAGATGCAGCAAAAGTATCTGC

TGCTTTGCTAGAAAAAGGCCAAAATCGTGTCATAGATGCTTCACTTACAC

TTATTCGAGAAAGAGCAAAGCTTAAGGGAGAACTTGTGCGTGCTTTGGGA

GGTGCTAAAGCAACTTCAACTCTTCTTGGAGTTCCTTTGGGACATAATTC

ATCGTTCCTTCAAGGGCCTGCATTTGCACCTCCTCGCATTAGGGAGGCCA

TTTGGTGTGGTAGCACCAACTCAACAACTGAAGAAGGCAAGGAATTACAA

GATGCACGAGTGCTAACTGATGTTGGTGATGTTCCTATCCAGGAAATTCG

AGATTGTGGGGTAGATGATCACAGATTAATGAATGTAATTGGTGAATCTG

TAAAGTTAGTGATGGAGGAGGATCCATTATGTCCCTTAGTTTTAGGCGGT

GATCACTCAATATCATTTCCAGATATCAGAGCTGTCTCTGAGAAGCTTGG

AGGACCAGTTGATGTTCTTCATCTTGATGCGCATCCTGATAACTATGATG

CCTTTGAAGGAAACATTTATTCACATGCTTCTTCTTTTGCTCGAGTCATG

GAGGGTGACTATGTTCGACGTCTCTTGCAGGTTGGTATTAGATCAATAAC

AGCTGAAGGGCGTGCACAAGCCAAAAAATTTGGTGTTGAGCAATATGAAA

TGCGAACATTTTCAAGGGATCGCCCCTTTCTAGAGAACCTGAAACTAGGG

GAAGGTGTTAAAGGTGTATATATCTCAATAGATGTGGATTGTCTCGATCC

CGCCTTTGCTCCAGGAGTGTCTCACATAGAGCCAGGAGGTCTTTCTTTCC

GTGATGTTCTCAACATCCTGCACAATCTTCAAGGCGCTGTTGTTGCTGGA

GACGTGGTCGAATTGAACCCGCAACGTGATACCGATGATGGAATG

SEQ ID NO:14.
Brassica napus (rape) arginase gene AF233433,
partial cds; ACCESSION AF233433:
ATGTCGAGGATTATTGGTAGAAAAGGGATTAACTATATCCATAGACTAAA

TTCTGCGTCGTTCACGAGCGTATCTGCTTCTTCAATCGAGAAGGGCAAAA

TCGTGTGATTGATGCTTCGTTAACTCTTATTCGTGAAAGGGCAAAACTCA

AAGGAGAGTTAGTGCGTCTTTTAGGTGGAGCTAAAGCTTCAACATCTCTT

CTTGGTGTACCACTTGGTCACAACTCTTCTTTTCTTCAAGGTCCTGCTTT

TGCTCCTCCTCGTATTCGAGAAGCTATTTGGTGTGGTAGCACAAACTCTG

CCACTGAAGAAGGAAAGGAGTTGAAGGATCCCCGGGTTCTAACTGATGTT

GGGGATGTTCCGGTACAAGAGATTATAGATTGTGGGGTTGATGATGATAG

ACTGATGAATGTCATAAGTGAATCTGTGAAGTTGGTGATGGAAGAGAAAC

CATTGCGTCCGTTGGTCTTAGGTGGAGACCATTCCATATCTTATCCTGTT

GTGAGAGCGGTTTCTGAGAAGCTTGGAGGGCCTGTGGACATTCTTCATCT

TGATGCACATCCGGATATATATGACTGTTTTGAAGGAAATAAGTACTCTC

ATGCATCTTCTTTTGCTCGTATCATGGAAGGTGGCTATGCGCGTAGGCTT

TTACAGGTTGGGATCAGATCGATAAACCAGGAAGGACGGGAACAAGGCAA

GAGGTTTGGAGTAGAACAGTATGAGATGCGAACCTTCTCGAAAGATCGCC

CAATGTTGGAAAATCTGAAATTAGGGGAAGGAGTGAAGGGGGTATACATC

TCGATAGACGTTGACTGTCTCGATCCGGCATTTGCACCTGGAGTGTCGCA

TATCGAACCAGGAGGTCTCTCTTTCCGTGACGTCCTTAACATCTTACACA

ACCTTCAGGCAGATGTTGTCGGGGCTGACGTTGTCGAGTTCAACCCGCAG

CGTGATACTGTTGACGGCATGACAGCAATGGTTGCAGCTAAGCTTGTTAG

AGA

SEQ ID NO:15.
Pinus taeda (loblolly pine) arginase (ARS20) mRNA,
Todd, ACCESSION AF130440:
GGCACGAGGAGCAATGGGGTCCATGGGAAAAATGGTGATGAGGTTTCTGC

AGAAGCGTAGTTTGGCAACTTTACCATCACAAATGATAGAGAAGGGCCAA

AACCGTGTTGTGGAAGCTTCCCTTACCCTGATCAGGGAGAGAGCAAAACT

CAAGGCAGAATTGGTGCAGGCATTGGGAGGCTCAATTGCAACGACTTGCC

TTCTAGGAGTTCCTTTGGGCACAATTCATCTTTCCTTCAAGGCCCTGCA

TTCGCTCCTCCTCGCATTCGAGAAGCTATTTGGTGTGGTAGTACAAATTC

CGCGACTGAGAAAGGGAAAGAATTGAAAGACTCGAGAGTGCTGTCAGATG

CTGGAGATGTTCCAATTCAAGAAATGCGAGATTGTGGGATTGAAGATGAG

AGGTTAATGAAAACTGTCAGTGACTCTGTAAAAATTGTAATGGAGGAGCC

TCCACTTCGTCCATTGGTTTTAGGTGGCGATCATTCAATATCCTACCCAG

TTGTTAAGGCTGTTACAGACCACCTTGGAGGGCCAGTGGATATTCTTCAT

TTAGATGCTCATCCTGATATTTATGATGCTTTTGAAGGAAATAAGTATTC

ACATGCTTCTTCATTTGCGCGAATTATGGAGGGTGGTCATGCAAGGCGAC

TTTTGCAAGTGGGCATCAGGTCTATAACAAAGGAAGGTCGGGAGCAAGGG

AAAAGATTTGGAGTAGAACAATATGAAATGCACAGTTTCAGTAAAGATCG

TGATTTCTTGGAGAATCTGAAACTTGGGGAAGGTGTGAAAGGCGTTTATA

TCTCAATTGATGTGGATTGCCTTGATCCGGCATTTGCACCTGGAGTCTCG

CACCTGGAACCGGGTGGTCTCTCTTTTCGTGGTGTCATGAACCTTGTACA

AAATTTGCAAGGAGACATTGTGGCGGCTGATGTTGTGGAATTTAATCCAC

AACGTGACACAGTTGATGGAATGACAGCAATGGTTGCTGCAAAGCTTGTA

AGAGAGCTGACGTCAAAGATGTCTAAGTTGGCTCATTGAAAGCAGCCATG

ATCTATTCTGTTTCATGATACATGAGATCTGTAACAGGAGGAAGTTCTAC

AATTTTGTGTGTACTTGAGAGAATAAAGGCCTCCATGTTAGGGTTCTTCT

TTGTAGAAGTGACTGAAGAATATCAAAAGCCTCAGTCCATGGATGCATCA

ATTTTGAACTATCCTGTGAATGCTTGACATAATAAGTGAATGATCAGGCT

CTTCTTGGATAGTTTCAAATTATTTCGTTTGTCTATTCATTTGTTCAAAT

TTATTTAATGAGTAAATGCTTCAATCAATTGGTTTCTGGTGATTAAAAAA

AAAAAAAATAAAAA

SEQ ID NO:16.
Populus (Poplar) homologue to UP|ARG1_ARATH TIGR
unigene TC4665 (Genbank EST AJ777022):
GCGTCCGCATCATTATCCAAAATCCAGCACAGCTTTCTTCCCTTCCTCTA

AAACGGCCACTCCTCTCTATGCGAGCGCCAATCCCCTTTCACCGTTCAAT

CGCTAATTGCTGTTCCCTCCCTCCGTCTGCTGTTCATCTAATCCCTCACT

CTCTCTTTCTCTCTACAAGATATGTCAATTATAGGGAAGAGAGGGATTCA

TTACTTGCAAAAACTAAAAACTGCAAATATCCCTCCCGAATTGCTAGAAA

AAGGCCAAAATCGCGTTATCGATGCTTCTCTCACGCTTATTCGCGAGCGT

GCTAAGCTTAAGGGAGAGCTTTTGCGCGCATTAGGAGGTGTTAAAGCATC

CTCAACGCTTCTTGGAGTTCCTTTGGGACACAATTCATCGTTTCTTCAAG

GACCGGCGTTTGCTCCTCCGCGTATCAGGGAAGCGATTTGGTGTGGCAGC

ACGAATTCGAGCACGGAAGAAGGTAAAGAATTAAATGATCCACGAGTGCT

AACAGATGTTGGTGATGTTCCGGTTCAAGAAATTCGAGATTGTGGTGTGG

ACGATGATAGACTGATGAATGTTATTAGTGAATCAGTCAAGCTCGTGATG

GAAGAGGATCCATTGCGTCCGTTAGTCTTAGGTGGTGACCACTCCATATC

TTTTCCTGTGGTTAGAGCTGTCTCTGAGAAGCTTGGAGGTCCTGTAGATA

TTCTTCATCTAGATGCCCATCCTGACATCTATCATTGCTTTGAAGGAAAT

AAGTATTCTCATGCATCTTCGTTTGCCCGGATTATGGAGGGTGGTTATGC

TCTCGGCTTTTGCAAGTGGGTATCAGATCAATAACAAAGAAGGGCGTGA

GCAAGGTAAACGTTTTGGAGTAGAGCAATATGAAATGCCAACCTTCTCAA

GGGATCGGCAGCTATTGGAAAAATCTGAAACTANGGGGAAGGTGTAAAAG

GTGTGTATATCTCCATANATGTGGACTGNCTTGATCCTGCCTTTGCTNCC

TGGCGTATCACATATTGAGCCAGGNGGNCTTTTCTTTCCCTAATGTTCTC

NACATTCTTCACAACCTTCAACCT

SEQ ID NO:17.
Picea glauca (white spruce) TIGR unigene TC2715
(Genbank CO477874):
NTTNTGCGGGCNGNNACAGAGCAGCTTGGAGGGCCTGTNGATNNNNNTCA

TTTAGATGCTCATCCTGATATTTATCATTCTTTTGAAGGAAACAAGTATT

CACATGCTNNNTCATTTGCACGAATTATGGAGGGTGGTCATGCAAGGCGA

CTTTTGCAAGTGGGCATCAGGTCTATAACAAAGGAAGGTCGGGAGCAAGG

TAAAAGATTTGGAGTAGAACAATACGAAATGCACAGTTTCAGTAAAGATC

GTGAATTCTTGGAGAATCTGAAACTTGGGGAAGGTGTAAAAGGCGTTTAT

ATCTCAATTGATGTGGATTGCCTTGACCCTGCTTTTGCACCTGGAGTCTC

GCATCTGGAGCCAGGTGGTCTCTCTTTTCGTGATGTCATGAACATTGTGC

AAAATCTGCAAGGAGACATTGTTGCAGCTGATGTTGTAGAATTTAACCCA

CAGCGTGACACAGTTGATGGAATGACAGCAATGGTTGCTGCAAAGCTTGT

AAGAGAACTGACGTCAAAGATGTCCAAGTTAGCTGATTGAAAGCAGCCGT

GATCTATTCTATTTCATGATCATGAGATCTGTAACAGGAGGAAGTTCTT

CAATTTTGTGAGTACTTCAGAGAATAAAGGCATGTCTATTGTCAGGGTTC

TTTTGAGTAGAAATGACTGAAGAATATCAAAAGACCCAGTGAATGGAAAA

CATCAATTTTGAACTATCCTGTGAATGCTTGATATGAATAAATGAAGGAT

CAGGCTCTTCTTGAATAGTTTCTAA

SEQ ID NO:18.
Lactuca sativa TIGR unigene TC13890 (Genbank
BQ863215):
AGGCCTCTCATTCCGAGATGTTCTCAACATTCTCCACAATCTTCAAGCCG

ATGTTGTTGGTGCAGATGTGGTTGAGTTCAACCCACAACGTGATACTGTT

GATGGGATGACTGGCATGGTTGCTGCTAAATTGGTCAGAGAGTTGACTGC

AAAAATATCTAAATGAAGAAACCACTTTTCTTGGTTTATCATTAAAAATA

AATATTAATGATGTAGCTTCATTTGAGTTATTCCGTTGGTTTATTTCCTG

TTTAAATCATATCTGAAGAACTCAAGTTGATCATAGTGAAAACCATCTTT

ACTAATTTAGCTAATGTTAACAAACTAAACGACAT

SEQ ID NO:19.
Cabernet Sauvignon TIGR unigene TC47457 (Genbank
EST CF210075):

CTGCATGCTATGTAGCTCATATAATCATCTTCTTCTTCAATCGCCACTCT

ATTCGTCACAGGGAAGAGTCCCCATTTCTTGATTTGTTATAGTTCAGTCT

CACTCAGGTATGAGGAATATTGCAAGGAAGGGAATTCATTACTGGCAGAA

ACTGAATGCTGCAAATGTCCCAGCTGAGTTGATAGAAAATGGCCAAATC

GTGTTATAGATGCTTCCCTTACTCTTATTCGTGAGAGGGCGAAGCTTAAG

GGGGAGCTTGTGCGAGCTTTAGGTGGTGCTTTAGCCTCATCATCTCTTCT

TGGAGTTCCTCTAGGACATAATTCATCATTCCTTCAAGGGCCAGCCTTTG

CTCCTCCTCGTATAAGGGAGGCAATCTGGTGTGGCAGCACAAACGCCACA

ACCGAAGAAGGGAAAGAATTAAATGATCCACGGGTGCTTACTGATGTTGG

TGATGTCCCTGTCCAAGAGATAAGAGATTGTGGTGTAGATGATGACAGGT

TGATGAAAATTATAAGTGAGTCTGTCAAGCTAGTGATGGAAGAAGATCCA

TTGCGCCCATTAGTTTTAGGTGGTGACCACTCAATATCATTTCCTGTTGT

AAGGGCTGTGTCTGAGAAGATTGGGGGTCCTGTAGATATTCTTCACCTGG

ATGCCCATCCTGACATTTATCATTCCTTTGAAGGAAACAAGTATTCACAT

GCATCTCCCTTTGCCCGGATCATGGAGGGTGGTTATGCTCGACGGCTTTT

GCAAGTTGGTCTTCGATCCATTACAAGTGAAGGCCGTGAACAAGGCAAGA

GATTCGGTGTGGAGCAATATGAAATGAGAACGTTTTCAAGAGATCGACAC

ATTTTGGAGAACCTGAAACTAGGGGAAGGCGTGAAGGGTGTATACATTTC

ATTAGATGTGGACTGTCTTGATCCTGCATTTGCTCCTGGGGTATCTCATA

TTGAGCCAGGAGGTCTTTCTTTCCGCGATGTTCTCAACATCCTCCACAAC

CTGCAAGCCGATGTTGTTGCCGCTGATGTGGTTGAGTTCAATCCGCAACG

TGACACAGTGGATGGGATGACTGCAATGGTTGCTGCCAAGCTGGTAAGAG

AACTGACTGCTAAGATGTCAAAAATGAAGAACTAGTGTGCCCTCTCTGTG

GGAGTTAATCATATTTTTCAATTTACGACTTACTGTTCTAGCATAACCAG

ATTTCTTCATCTTTCGTTTCTTTGAAGCATTTCTGAAGGAATTAAAATG

TATACCTGCCTGGCTCTCAGTGGCTTGGGAAACTTTTATAGAGCAGTTAT

TTCCTTGGAATAGTATTGTACTTCATCTCATGGAAGGAATCAGCATATAT

AAGAATAAACAATGTCATCAATTTTAATTGTTATATGAACATCTTCAAAG

TTGCATTATGAGGGAATGTTTTGGTGG

SEQ ID NO:20.
Saccharum officinarum TIGR unigene TC51697
(Genbank EST CA248345):
ACGTCTCCTCTGTCCTCTCCCCGCCTGCCTCTTGCGTCCTCCGCCTCTTT

TCCTGCTCGCTGGCAGCCGCGGTGTCCGATCGAGAGGGAGAGTGAGCCCG

AGGGGAGAGGGCTTAGTCGGGCTCCGCCTTGGGAGAGGACCAAGAGATGG

GCGGCGCGGCGGCGGGTACCAAGTGGATCCACCACATCCAGCGCCTCAGC

GCGGTGAAGGTGTCGGCGGAGGCGGTGGAACGGGCCAGAGCCGCGTCAT

CGACGCCTCCCTCACCCTCATCCGCGAGCGCGCAAAGCTCAAGGCAGAGT

TGCTACGTGCTCTGGGTGGCGTGAAAGCTTCAGCGTCGCTCTTAGGGGTC

CCTCTTGGTCACAACTCGTCCTTTTTGCAAGGCCCTGCATTTGCTCCTCC

ACGCATAAGGGAGGCCATTTGGTGTGGAAGCACAAATTCTAGCACAGAGG

AAGGCAAAGAATTGAATGATCCTCGGGTGCTAACTGATGTTGGTGATGTC

-continued

CCCATTCAAGAGATCCGTGACTGTGGCGTTGAAGATGACAGATTGATGCA

TGTAATTAGTGAGTCTGTTAAAACAGTGATGGAGGAGGAGCCTCTTCGAC

CGTTGGTGTTAGGAGGCGATCACTCGATATCTTATCCAGTGGTTAGAGCT

GTGTCTGAAAAGCTTGGAGGACCTGTTGACATTCTTCATCTTGATGCACA

TCCAGATATCTATGATTGTTTTGAAGGGAACACTTATTCACATGCCTCTT

CATTTGCTAGAATTATGGAAGGTGGTTATGCCAGGAGACTGCTACAGGTT

GGATTGAGATCAATTACCAAAGAAGGCCGTGAGCAAGGGAAGAGATTTGG

TGTGGAACAATATGAGATGCGAACCTTCTCAAAG

SEQ ID NO:21.
Gossypium Cotton TIGR unigene TC32845 (Genbank EST
CO128957):
GTTCATACAAGGCACGCAAGCAACGAAACCTGCCCATTGCTTCTTTCCAT

GTCCAATTCCCCTGTTTCTTACTCAATAACCTAAAGCTTTTAAGTTTCTT

CTTCATCTTCAAGTTTAAGACATGTCGAGCTCGGGGGTAGTGCGAAGAGG

AATTCATTATTTGCAAAAGCTAAAAGCCGCGAATATACCTTCTGATTTGA

TAGAAAAGGGCCAAAATCGTGTTATCGATGCTTCTCTTACCCTTATTCGG

GAGAGGGCAAAGCTCAAGGGAGAACTTGTGCGTGCTTTGGGCGGTGCTTT

AGCATCAACATCACTGCTTGGAGTTCCTTTAGGACATAATTCATCGTTTC

TTCAAGGACCCGCTTTTGCTCCTCCTCGTATTCGGGAGGCTATCTGGTGT

GGCAGCACTAACTCAGCCACTGAAGAAGGCAAGGAACTAAATGATCCACG

GGTGCTAACTGATGTTGGTGATGTCCCTGTCCAAGAAATACGTGATTGTG

GTGTAGATGATGATAGATTGATGAGTGTCATAAGTGAATCTGTCAAGCTA

GTAATGGAGGAGGATCCGTTACGCCCATTAGTTTTAGGCGGTGACCACTC

GATATCCTTTCCTGTTGTAAGAGCGGTCTCTGAGAAGCTTGGTGGACCTG

TTGATATACTTCATTTAGATGCCCATCCTGATATTTACGATTGTTTTGAA

GGAAATAAGTATTCACATGCATCTTCTTTTGCTCGAATTATGGAGGGTGG

TTATGCTAGGCGGCTTTTGCAGGTCGGTATCGATCGATAACAACTGAAG

GGCGCGAACAAGGAAAAAGGTTCGGAGTGGAGCAATACGAAATGCGAACA

TTTTCAAAAGACTGTCATTTCTTGGAAAACCTGAAACTAGGGGAAGGAGT

AAAGGGTGTGTATATTTCAGTAGATGTGGACTGTCTTGATCCAGCCTTTG

CCCCGGGGGTATCTCACATCGAACCGGGAGGCCTTTCCTTTCGTGATGTT

CTCAATATCCTACCCAATCTTGAAGGAAATCTGGTTGCTGCCGATGTAGT

AGAGTTCAATCCCCAACGTGACCCCGTCGATGGAATGACTGCAATGGTTG

CTGCTAAGCTTGTAAGAGAACTGGCTGCTAAGATGTCAAAATGATAAGTT

GTCTTAAATTTCTATGTTAAGGTCTTTGGATGTTTCATTTCTATTTAGCT

TAAACTTATGACAATGCTACTGGCAATCTTATAGCTAAATAAGATTTATA

TTGTTTAGACTCTTCCTTTTTTTCTGAAATATTCAAGAGATGAGATG

SEQ ID NO:22.
Sorghum (Sorghum bicolor) TIGR unigene TC103916
(Genbank EST CD227766):
ACGTGTGGGTTACGTGAGAGTGAAGAAGAGCCGCCGGCAACGCCGCCGCG

GCACGTCTCCTCCAGCTGCCTCTTGCGTCCTCCGCCGCCTCTTTTCCTGC

TCGCTGGCAGCCGCGGATCCATCGAGAATCGAGAGTTGGGGGGGGGAGA

GTGAGCCCGAGGGGAGAGGGCTCTAGTCGGGTTCCGCCGAAGAGATGGGC

GGCGCGGCGGCGGGTACCAAGTGGATCCACCACATCCAGCGCCTCAGCGC

GGCGAAGGTGTCGACGGAGGCGGTGGAGCGGGGCCAGAGCCGCGTCATCG

ACGCCTCACTCACCCTCATCCGCGAGCGCGCAAAGCTCAAGGCAGAGTTG

CTGCGTGCTCTGGGTGGCGTGAAAGCTTCAGCGTCGCTCTTAGGGGTCCC

TCTTGGTCACAACTCATCCTTTTTACAAGGCCCTGCATTTGCTCCTCCAC

GCATAAGGGAGGCCATTTGGTGTGGAAGCACAAACTCTAGCACAGAGGAA

GGCAAAGAATTGAATGATCCTCGGGTGCTAACTGATGTTGGAGATGTCCC

CATTCAAGAGATCCGTGACTGTGGCGTCGAAGATGACAGATTGATGCATG

TAATTAGTGAGTCTGTCAAAACAGTGATGGAGGAGGAGCCTCTTCGACCG

TTGGTGTTAGGAGGCGATCACTCGATATCTTATCCAGTGGTTAGAGCTGT

GTCTGAAAAGCTTGGAGGACCTGTTGACATTCTTCATCTTGATGCACATC

CAGATATCTATGACTGTTTTGAAGGGAACACTTATTCACATGCCTCTTCA

TTTGCCAGAATAATGGAAGGTGGTTATGCCAGGAGACTGCTACAGGTTGG

ATTGAGATCAATTACCAAAGAAGGGCGTGAGCAAGGGAAGAGATTTGGTG

TGGAACAGTATGAGATGCGAACCTTCTCAAAGGACCGAGAGAAGCTTGAG

AATCTGAAACTTGGGGAAGGTGTAAAGGGAGTGTATGTCTCAGTTGATGT

GGACTGCCTTGACCCAGCGTTTGCTCCCGGTGTCTCTCACATTGAGCCAG

GAGGCCTCTCGTTCCGCGATGTGCTCAACATCCTCCAGAATTTGCAGGGT

GACGTTGTCGCCGCCGATGTGGTGGAGTTCAACCCACAGCGTGACACGGT

GGATGGGATGACAGCCATGGTCGCCGCGAAACTGGTCCGGGAGCTCACTG

CTAAGATTTCCAAGTGAGACGGTCAGGATCACACCATTCTTCGTGAAGCA

ATGTGAAAGTGTGGATTTTGATGTCTCGGTGGTTTCTTGGTCTTGGTTCA

TTTGTATCGAGCACCAAACGCTTCGACATGTGACAAAGCTTATGTTAATG

TTAACAACGTAAAGTTGTTTTCTCCTACTCCTATTTAGATCATTCTAGAT

GCTTACCATGTATTTAGGGTGGGGATTATGAAACCAAACATGCCAGATTC

TAGAACAAATGCTCCGA

SEQ ID NO:23.
Zea mays TIGR unigene TC270225 (Genbank;
AY106166):
CCACGCGTCCGCAGAGATTCGAAGAAGACACAAATAAAATCTCGCCAAAT

TCATGAACTCTCTAGTCTCTACTCTCTTCTCCTGGCAACGATTTCCAAAC

GCACGCAAACGCTGTCACAGTTTGTCACGGCAGCGGCAAGTCGGCAACGC

TGCCGCGGCACGTCTCCTCCCTCTCTTTTCCGGTTCGGGTAGTCGGGTGT

ACCGCCATTCGTGATCGAACCAGACTCGAGAGGGAGAGGAGGAGGGAGTC

CGAGGGGAGAGACCCAATTAGCTGCAGGGATTGGTCGGGTTCGGCTCCGC

CTTCGGAGAGTCCCAAGAGATGGGTGGCGCGGCGGCGGGTACCAAGTGGA

TCCACCACATCCAGCGCCTCAGCGCGGCCAAGGTGTCGGCGGAGGCGGTG

GAGCGGGGCCAGAGCCGCGTCATCGACGCCTCCCTCACCCTAATTCGCGA

GCGCGCAAAGCTCAAGGCAGAGTTGCTGCGTGCTCTGGGTGGCGTGAAAG

CTTCAGCGTCGCTCTTAGGGGTCCCTCTTGGTCACAACTCATCCTTTTTA

CAAGGCCCTGCATTTGCTCCTCCACGCATACGGGAGGCCATTTGGTGTGG

AAGCACAAACTCTAGCACAGAGGAAGGCAAAGAATTGAATGATCCTCGGG

-continued

TGCTAACTGATGTTGGAGATGTCCCCATTCACGAGATCCGTGACTGTGGT
GTCGAAGATGACAGATTAATGCATGTAATTAGTGAGTCTGTCAAAACAGT
GATGGAGGAGGAGCCTCTTCGACCGTTGGTGTTAGGAGGCGATCATTCAA
TATCTTATCCAGTGGTTAGAGCTGTGTCTGAAAAGCTTGGAGGACCTGTT
GACATACTTCATCTTGATGCACATCCAGATATCTATGATTGTTTTGAAGG
GAACACTTATTCGCATGCCTCGTCATTTGCCAGAATAATGGAAGGTGGTT
ATGCCAGGAGACTGCTACAGGTTGGATTGAGATCAATCACCAAAGAAGGG
CGTGAACAAGGGAAGAGATTTGGTGTGGAACAGTATGAGATGCGAACCTT
CTCAAAGGACCGAGAGAAGCTTGAGAATCTGAAACTTGGGGAAGGCGTAA
AGGGTGTGTATGTCTCAGTTGATGTGGACTGCCTTGACCCAGCGTTTGCT
CCTGGGGTCTCTCACATCGAACCTGGAGGCCTCTCCTTCCGCAATGTCCT
CAACATCCTCCAGAATTTGCAGGGTGACGTTGTCGCCGCTGATGTGGTGG
AGTTCAACCCACAGCGTGACACGGTAGATGGGATGACAGCCATGGTCGCC
GCGAAGCTGGTTCGGGAGCTCACTGCTAAGATCTCCAAGTGAAACGGTCA
GGATTGCACCACTCTTCTTGAAGCAAAGCGAAAGGGTGGGTTTTGATGTC
CCGGTGGTTATTGGTCATGGTTTCTATGTATCGAGCACCAAATTGTTCGA
CATGTGACAGGTTTATATGTTAATTAGGTTGCAATAACACCATAATGGTT
TATTTAAAAAAAAAAAAAAAAAAAAAAA

SEQ ID NO:24
Hordeum vulgare TIGR unigene TC147457 (Genbank EST CA022688):
CGGCACGAGGGTGCATTTCACTCTCTTGGTATTACGTTACGTCTCTTCCT
TCCTTCTTCAGTTCCCCACAGGCGAGAGGCCGCTCCGCTCGCTTGCCTTC
CTCCTTCCCACCCCTCGACGATTCCTCGGCGATGGGCGGCGCGGCGGCGG
CGGCGTCGGGCGCCGCCAGGTGGATCCAGCGGCTGAGCGCGGCCAGGATC
TCGACGGAGGCGCTGGAGCGGGGCCAGAGCCGCGTCATCGACGCCTCCCT
CACCCTCATCCGCGAGCGCGCCAAGCTCAAGGGAGAGTTGCTGCGCGCTA
TGGGTGGTGTGAAAGCTTCTGCGACACTCTTGGGAGTACCCCTTGGGCAC
AACTCATCTTTCTTGCAGGGGCCTGCATTTGCTCCTCCTCGCATAAGGGA
GGCCATTTGGTGTGGAAGCACCAACTCTAGCACAGAAGAAGGCAAGGAAT
TAAATGATCCAAGAGTGCTAACTGATGTTGGTGATGTCCCTATACAAGAG
ATTCGTGACTGTGGTGTTGAAGATGACAGATTGATGCATGTAATCAGCGA
TTCTGTCAAAACTGTGATGGACGAAGATCCTCTTCGGCCGTTGGTCTTAG
GAGGCGATCACTCGATATCTTATCCAGTTGTTAGGGCTGTGTCTGAAAAG
CTTGGCGGACCTGTTGACATTCTTCATCTTGACGCACATCCAGATATCTA
TGATTGTTTTGAAGGGAACACTTACTCACACGCTTCTTCATTTGCAAGAA
TAATGGAAGGAGGTTATGCGAGGCGACTTTTGCAGGTTGGACTTAGATCA
ATTACCAAGAAGGACGTGAGCAAGGGAAGAGATTTGGTGTGGAACAGTA
TGAGATGCGCACCTTCTCCAGAGATCGGGAGAAGCTTGAGAATCTGAAAC
TTGGGGAAGGTGTGAAGGGGTGTATGTCTCCGTCGACGTGGACTGCCTT
GACCCCGCATTCGCTCCTGGTGTCTCTCATATCGAGCCGGGAGGCCTCTC
GTTTCGCGACGTGCTCAACATCCTCCAGAATCTGCAAGGTGATGTCGTCG
CCGGAGATGTGGTGGAGTTCAACCCACAGCGCGACACGGTCGACGGGATG
ACGGCTATGGTCGCCGCAAAGCTGGTCCGGGAGCTGAGCGCCAAGATCTC
AAAATGAGGAGAGCCCTGGCCAGTCAGGACATAAGCAGCAAAGAGGATTT
TCAGGCACAATGGTCCTTGACCTTAGTTCCTGCCAATCATTTGTGCCACA
TTTTAGTCTGACAATCTTCTATAAATAATAAAATCAGGCTGCAAAAACGT
CTTTGAATTTGGTATGTGCTATGTGGTACTTGTTGGTTCTCCTTTCACAT
GCACGCATCCAAGATTAAT SEQ ID NO:25.
Triticum aestivum TIGR unigene TC108421 (Genbank EST CD913000):
GCCGCTTCGCTCGTTTGCTTCTCTCGCCGTCTCCTCCTCCAGTCCTCCTC
CCCAGTTCCCACCCCCTCGACGATTCCTCGGCGATGGGCGGCGCGGCGGC
GGCGGCGGGCGCCGCCAGGTGGATCCAGCGGCTGAGCGCGGCCAGGATCT
CGACGGAGGCGCTGGAGCGGGGCCAGAGCCGCGTCATCGACGCCTCCCTC
ACCCTCATCCGCGAGCGCGCCAAGCTCAAGGGAGAGTTGCTGCGTGCTAT
GGGTGGTGTCAAAGCTTCTGCGACACTCTTAGGAGTACCCCTTGGGCACA
ACTCATCTTTCTTGCAGGGGCCTGCATTTGCGCCTCCTCGCATAAGGGAG
GCCATTTGGTGTGGAAGCACCAACTCTAGCACAGAAGAAGGCAAAGAATT
AAATGATCCAAGAGTGCTAACTGATGTTGGTGATGTCCCCATACAAGAGA
TTCGTGACTGTGGTGTTGAAGATGACAGATTGATGCATGTAATCAGCGAG
TCTGTCAAAACAGTGATGGACGAAGACCCTCTTCGGCCGTTGGTCTTAGG
AGGCGATCACTCGATATCTTATCCAGTTGTTAGGGCTGTGTCTGAAAAGC
TTGGCGGACCTGTTGACATTCTTCATCTTGACGCACATCCAGATATCTAT
GACTGTTTTGAAGGCAACACTTACTCACACGCTTCTTCATTTGCAAGAAT
AATGGAAGGAGGTTATGCGAGGCGACTTTTGCAGGTTGGACTTAGATCAA
TTACCAAAGAAGGACGTGAGCAAGGGAAGAGATTTGGTGTGGAACAGTAT
GAGATGCGCACCTTCTCCAGAGATCGGGAGAAGCTTGAGAATCTGAAACT
TGGGGAAGGTGTGAAGGGGGTGTATGTCTCCGTTGACGTGGACTGCCTCG
ACCCCGCATTCGCTCCTGGCGTGTCTCATATCGAGCCGGGAGGCCTCTCA
TTTCGCGACGTGCTCAACATCCTCCAGAATCTGCAAGGCGATGTCGTCGC
CGGAGATGTGGTGGAGTTCAACCCGCAGCGCGACACGGTCGACGGGATGA
CGGCTATGGTCGCCGCGAAGCTGGTCCGGGAGCTGAGCGCCAAGATCTCA
AAATGAGCAGCGACAGTCAGGACAGAGGCAGCAGCAGAGAGGATTTTCAG
GCACAGTGGTCGTTGATCTTAGTTCCTGCCAATCATTCAGTTGTGCCACG
TTTTAGTCTGACAATCTTCTATAAATAATAAAATCAGGCTGCAAAAACGAC
TTCGAATTTGGTATGTGCTCTGTGGTATTTGTTGGTTCTCCTTTCACATG
CACGCATCCAAGATTAAGCTCGTAGGTGCCTAGTAGTCGATAAGAACATC
GTCTCTCACGCAAAGGATATGTTGAAAAATCTGAAATGAATTTGAAAAAT
C SEQ ID NO:26.
Oryza sativa (japonica cultivar-group) TIGR uni-
gene TC275196 (Genbank EST CR288830):
GCATGTGTGGTACCGGGAATCGGCATTATGGCGGGGGGGCGGTGCACTG
CATTATTGTTGCCTCGCTCGCTCGATCGATCCCCTCTCCTCTCCAAATCC
CATCCCCAAATCCCGAATCCTCCATCGAGATCGATCGACGTCGAGCGGAG
CGAAGGGGGATATGGGCGGCGTGGCGGCGGGCACCAGGTGGATCCACCA
CGTCCGGCGGCTCAGCGCCGCCAAGGTGTCGGCGGACGCCCTGGAGCGCG
GCCAGAGCCGGGTCATCGACGCCTCCCTCACCCTCATCCGCGAGCGCGCC
AAGCTCAAGGCAGAGTTGCTGCGCGCTCTTGGTGGTGTGAAAGCTTCAGC
ATGCCTCTTAGGTGTTCCTCTTGGTCACAACTCATCGTTCTTACAGGGAC
CTGCATTTGCTCCTCCCCGGATAAGGGAAGCCATTTGGTGTGGAAGTACC
AACTCTAGCACAGAAGAAGGCAAAGAACTCAATGATCCTCGAGTGCTAAC
AGATGTTGGTGATGTCCCCATACAAGAGATTCGTGACTGTGGTGTTGAAG
ATGACAGATTGATGAATGTTGTAAGCGAGTCTGTCAAAACAGTGATGGAG
GAAGATCCTCTTCGGCCATTGGTCCTGGGAGGCGATCACTCAATATCTTA
TCCAGTTGTTAGGGCTGTGTCTGAAAAGCTTGGTGGACCTGTTGACATTC
TTCACCTTGACGCACATCCAGATATCTACGATGCTTTTGAAGGAACATCT
ATTCGCATGCTTCTTCATTTGCAAGAATAATGGAAGGAGGTTATGCTAGG
AGGCTTCTACAGGTTGGAATCAGATCAATTACCAAAGAAGGGCGTGAGCA
GGGGAAGAGATTTGGTGTGGAACAGTATGAGATGCGCACTTTTTCAAAGA
TAGGGAGAAGCTTGAAAGTCTGAAACTTGGGGAAGGTGTGAAGGGAGTGT
ACATCTCAGTTGACGTGGACTGCCTCGATCCCGCTTTCGCGCCAGGTGTC
TCTCACATTGAGCCAGGAGGCCTCTCCTTCCGCGACGTGCTCAACATCCT
CCATAACCTGCAAGGAGATGTTGTCGCCGGAGATGTGGTGGAGTTCAACC
CGCAGCGTGACACGGTGGACGGGATGACGGCTATGGTTGCAGCCAAGCTG
GTCCGGGAGCTCACAGCCAAGATCTCCAAGTGAGCATCCATTCAGATTCA
GGGCATATCATATCACCAACCAACCCCTTGAGTCTGAAGCAGCAAAGAGG
ATGATTCCCAGACTCCTTTAGCTGTTAGTCTAGGTTCCTATGTAGTAGAC
ATCAGCTATGCCAGATTTTGTATGTGACAGTCATTTATATACTCATTAGG
TTGCAATAATGTTTGCCTCCATTTTGCACTTGTGATGTTATGGTTATCCC
TCATCATCGTGTGCTAGAAGAATGCATATGAACCGTTTTTGTCGTGCTTT
CAGGCAACATGCTGACGACAAAAATGCTTGGCCAATAAGAGTAATAAATT
ATTGGCATTTTAAAGACAG SEQ ID NO:27.
Oryza sativa (japonica cultivar-group), XM_470981:
TGGCGGCGGGCACCAGGTGGATCCACCACGTCCGGCGGCTCAGCGCCGCC
AAGGTGTCGGCGGACGCCCTGGAGCGCGGCCAGAGCCGGGTCATCGACGC
CTCCCTCACCCTCATCCGCGAGCGCGCCAAGCTCAAGGCAGAGTTGCTGC
GCGCTCTTGGTGGTGTGAAAGCTTCAGCATGCCTCTTAGGTGTTCCTCTT
GGTCACAACTCATCGTTCTTACAGGGACCTGCATTTGCTCCTCCCCGGAT
AAGGGAAGCCATTTGGTGTGGAAGTACCAACTCTAGCACAGAAGAAGGCA
AAGAACTCAATGATCCTCGAGTGCTAACAGATGTTGGTGATGTCCCCATA CAAGAGATTCGTGACTGTGGTGTTGAAGATGACAGATTGATGAATGTTGT
AAGCGAGTCTGTCAAAACAGTGATGGAGGAAGATCCTCTTCGGCCATTGG
TCCTGGGAGGCGATCACTCAATATCTTATCCAGTTGTTAGGGCTGTGTCT
GAAAAGCTTGGTGGACCTGTTGACATTCTTCACCTTGACGCACATCCAGA
TATCTACGATGCTTTTGAAGGAAACATCTATTCGCATGCTTCTTCATTTG
CAAGAATAATGGAAGGAGGTTATGCTAGGAGGCTTCTACAGGTTGGAATC
AGATCAATTACCAAAGAAGGGCGTGAGCAGGGGAAGAGATTTGGTGTGGA
ACAGTATGAGATGCGCACTTTTTCAAAAGATAGGGAGAAGCTTGAAAGTC
TGAAACTTGGGGAAGGTGTGAAGGGAGTGTACATCTCAGTTGACGTGGAC
TGCCTCGATCCCGCTTTCGCGCCAGGTGTCTCTCACATTGAGCCAGGAGG
CCTCTCCTTCCGCGACGTGCTCAACATCCTCCATAACCTGCAAGGAGATG
TTGTCGCCGGAGATGTGGTGGAGTTCAACCCGCAGCGTGACACGGTGGAC
GGGATGACGGCTATGGTTGCAGCCAAGCTGGTCCGGGAGCTCACAGCCAA
GATCTCCAAGTGA SEQ ID NO:28.
Populus (Poplar) TIGR unigene TC4665 (Genbank EST
AJ777022):
GCGTCCGCATCATTATCCAAAATCCAGCACAGCTTTCTTCCCTTCCTCTA
AAACGGCCACTCCTCTCTATGCGAGCGCCAATCCCCTTTCACCGTTCAAT
CGCTAATTGCTGTTCCCTCCCTCCGTCTGCTGTTCATCTAATCCCTCACT
CTCTCTTTCTCTCTACAAGATATGTCAATTATAGGGAAGAGAGGGATTCA
TTACTTGCAAAAACTAAAAACTGCAAATATCCCTCCCGAATTGCTAGAAA
AAGGCCAAAATCGCGTTATCGATGCTTCTCTCACGCTTATTCGCGAGCGT
GCTAAGCTTAAGGGAGAGCTTTTGCGCGCATTAGGAGGTGTTAAAGCATC
CTCAACGCTTCTTGGAGTTCCTTTGGGACACAATTCATCGTTTCTTCAAG
GACCGGCGTTTGCTCCTCCGCGTATCAGGGAAGCGATTTGGTGTGGAGC
ACGAATTCGAGCACGGAAGAAGGTAAAGAATTAAATGATCCACGAGTGCT
AACAGATGTTGGTGATGTTCCGGTTCAAGAAATTCGAGATTGTGGTGTGG
ACGATGATAGACTGATGAATGTTATTAGTGAATCAGTCAAGCTCGTGATG
GAAGAGGATCCATTGCGTCCGTTAGTCTTAGGTGGTGACCACTCCATATC
TTTTCCTGTGGTTAGAGCTGTCTCTGAGAAGCTTGGAGGTCCTGTAGATA
TTCTTCATCTAGATGCCCATCCTGACATCTATCATTGCTTTGAAGGAAAT
AAGTATTCTCATGCATCTTCGTTTGCCCGGATTATGGAGGGTGGTTATGC
TCTCGGCTTTTGCAAGTGGGTATCAGATCAATAACAAAAGAAGGGCGTGA
GCAAGGTAAACGTTTTGGAGTAGAGCAATATGAAATGCCAACCTTCTCAA
GGGATCGGCAGCTATTGGAAAAATCTGAAACTANGGGGAAGGTGTAAAAG
GTGTGTATATCTCCATANATGTGGACTGNCTTGATCCTGCCTTTGCTNCC
TGGCGTATCACATATTGAGCCAGGNGGNCTTTTCTTTCCCTAATGTTCTC
NACATTCTTCACAACCTTCAACCT SEQ ID NO:29.
Mesembryanthemum crystallinum (common iceplant)
TIGR unigene TC4665 (Genbank BE036933):
AGCACGAGCTCAATCTCACGAATCAATCAGTCATGCAGAATATTGCAAGG AGGGGAATCCATTACTTATCGAAATTGAATGCTGCAAACGTTCCTTCTGA
TTTGATTGAAAAAGGTCAAAACCGAGTGATAGATGCCTCTCTCACCCTCA
TTCCTGAGAGAGCAAAGCTTAAGGGGGAGCTTGCGCGGGCCTTATGAGGC
GCCAAAGCATCATCATCACTCATTGGAGTCCCTCTAGGGCATAATTCATC
ATTTCTTCAGGGTCCTGCATTTGCACCTCCACGTATTAGGGAAGCAATTT
GGTGTGGAAGTACAAACTCATCAACTGAAGAAGGCAAGGACTTAAGTGAC
CCACGAGTCCTAACAGATGTTGGTGATGTTCCTGTTCAAGAGATCAGAGA
TTGTGGAGTGAATGATGACAGATTGATGAGCATTATCAGTGAGTCAGTTA
AGCTTGTCATGGAAGAAGATCCTTTGCGGCCTTTAGTTATTAGGTGGTGA
TCATTCAATATTTTACCCGGTTGTAAGAGCTGTCTCTTGAAAGCTAGGAG
GACCCGTAGATATTTTGCATCTTGAAGCTCAATCCCGATATTATCATGCC
CTTTGAGGGGAACAAGTATTCCCAGGCATCTTTTTTTGCCCCTATAATGG
AAGGTGGCTTTTGTGGGAGGGTTTTGCAAGCTGGTTTTAAGATCTATAAA
TACCTGCAAGGTCCAGAGCAACGGAAAAAAATTTGGTGTTGGGGCACATT
TAAAATGGGAACATTTTTCAAGAAGAACGCCCATTATTTTGTGAAAACTT
TGAAACTTCGGCAAGGGGGTTGAAAGTGGGGAACCAATATAAAATAAAGT
AGGAACGTGTTCTGAATCCTTCAATTTTCACCNCGTGTTTATTCTAAAAC
ATGAGACCCGGACGGCCATGTATTTTCT SEQ ID NO:30.
Allium cepa (onion) TIGR unigene TC890 (Genbank
ACABQ32):
AAACAAAAGACTTCTGCTCCCGTACGTCTTCTACCTTCTCTGCTCTTTTT
ATGAACTACACGTATGAATTCAATTTGCCATAATTCTGTCTGTACAAGGA
ATATTTGTTTTTACTAGAATTGCGGAAGGAAGATGAGCACTCACGCAATA
AAATGGATCCAATCTTTGAAGAGAATGAGCACGGGAAATCTACCGGCCGA
GATTATAGAGAAAGGGCAAAATCGGGTTATCGAGGCCTCTCTTACTCTCA
TCCGAGAAAGAGCCAAGCTTAAGGGAGAATTATTACGAGCACTGGGAGGT
GCTAAAGCTTCAGCAACACTACTGGGGGTTCCTTTAGGCCACAATTCTTC
ATTTTTACAAGGTCCTGCCTTTGCGCCTCCCAGGATTAGGGAAGCTATAT
GGTGTGGTAGCACAAACTCTGCTACCGAAGAGGGCAAGGATTTAAAAGAT
TCTCGCATATTGACCGATGTTGGCGACGTACCAATTCAAGAGATTCGGGA
TTGTGGTGTAGATGACGATAGATTAATGAATATAATCAGTGAATCTGTGA
AATTGGTGATGGAAGAACATCCACTTCGTCCATTGGTGTTGGGTGGAGAT
CACTCAATATCATACCCTGTAGTTAGAGCTGTAGCAGAAAAACTTGGAGG
ACCTGTGGATATCCTTCACTTAGATGCACATCCAGATATCTACGATGCAT
TTGAAGGAAATAAATACTCACATGCTTCTTCCTTTGGGAAGATAATGGAA
GGAGGTCATGCCAGGCGCCCTTTTACAAGTTGGAATAAGGGTCAATTACT
GATGAAGGACGGGAACAAGGGAA SEQ ID NO:31.
Capsicum annuum (pepper) TIGR unigene TC2786
(Genbank BM068212):
GGTGGTTATGCTCGCCGGCTTTGCCAAGTGGGAATTAGATCAATTAATAA
AGAAGGTCGGGAACAAGGAAAAAGGTTTGGTGTGGAGCAATATGAAATGC
GGACATTTTCCCGAGACCGCGAATATTTGGAGAATCTGAAACTTGGAGAA
GGTGTGAAGGGCGTGTATATCTCCGTGGATCTCGACTGTATGGATCCAGC
ATTTGCTCCTGGGGTATCTCATATAGAGCCAGGGGGTCTCTCTTTCCGTG
ATGTTTTAAACATACTGCATAACCTTCAAGCTGATGTTGTTGGTGCTGAT
GTCGTTGAGTTCAACCCACAGCGCGACACTGTTGATGGCATGACTGCAAT
GGTTGCTGCGAAGCTGGTAAGAGAACTTACTGCCAAGATATCCAAGTGGC
CTGCAGTAATTCCAAATTTATGAAGGACACAGACCATGCGTCAAATGGAG
AACGCTAGATTTATACTCATCCTTACTGGAAGTTTGACGGAGGATAAGCA
CCAACAAAGTGTTTATTCACCTTATTGTAGCACTAAAGCACATTAGGACT
TAAAATTAAAGTATTAGATAGGTCTGGTAGACGCTCAGTTTCCTATTGCA
AGATCGAATTACTCAATGGGAATATTATTTCATGTCATTGATTGGATTA
TCTGCCAACTTGTTTCCCAAAATAAGCTATCTCTGCAGTTCCTTATGTTT
GTGTATG SEQ ID NO:32.
Theobroma cacao (cacao) TIGR unigene TC466
(Genbank CF973050):
CCCNGCCTCTGATCTTCCTTTTCCAAGAAAACCTCCAATTCTTCGCCTTT
CATTGCGAACATGTCAGCCATAGGGCCGGAGCAGAGGAATTCATTATTTG
CAGAAACTGAGTGCTGCAAATATNCCTTCTGATTTGATCGAAAAGGGCCA
GAGTCGTGTAATAGATGCTTCTCTCACCCTTATTCGCGAGAAGGCAAAGC
TCAAGGGTGAGCTTGTGCGTGCTTTAGGAGGTTCTTTAGCATCCACTTCT
CTGCTTGGAGTTCCCTTAGGACATAACTCGTCGTTTCTTCAAGGACCGGC
GTTTGCTCTTCCTCGAATTAGGGAGGCAATGTGGTGTGGTAGCACGAACT
CATCCACTGAAGAAGGGAAGGAACTAAAGGATCCTCGGGTGCTAACTGAT
GTTGGTGACCTCGCTGTCCAGGAGATCCGTGATTGTGGCGTAGATGATGA
TAGATTGATGAACGTCGTAAGTGAGTCTGTCAAGATAGTAATGGAGGAGG
ATCCATTACGCCCATTAGTTTTAGGTGGTGNCCACTCAATATCTTATCCT
GT SEQ ID NO:33.
Medicago truncatula TIGR unigene TC87301 (Genbank
EST BI271401);
TGAAGATACATTGGATATACGTGGAAAAAAGACACATTAGCGAAATAAAT
CCTTTATAATTAGCGCCACTCCACTCGCTCTCTCTCCTCCATAACGAGTT
TCCTCTGTTCTCTGCCAACTTTCACAGAAATGTCGACGATAGCACGTAGA
GGCATCCATTACATGCAGAGACTGAATTCGGCAAATGTATCATCTGCTTT
GCTAGAGAATGGCCAAAATCGTGTAATTGACGCTTCACTTACCCTGATTA
GAGAAAGAGCAAAGCTTAAGGGAGAACTCGTGCGTGCTTTGGGAGGTGCT
GTTGCAACTTCATCGCTTCTTGGAGTTCCTTTGGGTCATAATTCCTCATT
CCTTCAAGGGCCTGCATTTGCACCTCCTCGCATTAGGGAGGCCATTTGGT
GTGGTAGTACAAACTCGACAACCGAAGAAGGTAAGGATTTACAGGACGCA
CGAGTGCTAACTGATGTTGGTGATGTCCCTATTCAAGAAATTCGAGATTG
TGGTGTAGATGATCATAGATTGATGAATGTCATTGGTGAATCTGTCAAGT
TAGTGATGGAAGAGGATCCGTTAAGGCCCTTAGTTTTGGGTGGCGATCAC -continued TCAATATCATTTCCCGTTATTAGAGCCGTCTCTGAGAAGCTTGGAGGACC
GGTTGATGTTCTTCATCTTGATGCACACCCCGATAACTATGATGAATTTG
AAGGAAACTATTATTCACATGCTTCTTCTTTTGCTCGAGTCATGGAGGGT
AACTATGTTCGGCGACTCTTGCAGGTTGGTATACGTTCAATAACAACTGA
AGGACGCGCACAAGCAAAAAGTTTGGCGTTGAGCAATATGAAATGCGAA
CATTTTCCAGAGATCGCCACTTCCTAGAGAACCTGAAACTAGGGGAAGGT
GTGAAAGGTGTATATATCTCAATAGATGTGGATTGTCTTGATCCTGCTTT
TGCTCCTGGAGTGTCTCACATAGAACCAGGAGGTCTTTCATTCCGCGATG
TTCTTAACATCCTACACAATCTTCAAGGCGATGTTGTGGCTGGAGATGTG
GTTGAATTCAACCCACAACGCGATACTGTCGATGAATGACTGCTATGGT
AGCTGCTAAGTTGGTGAGAGAATTGGCTGCAAAGATTGCAAATGATAAA
TCTCATGACTCCAGATATTTATTTCCTAAATACACTTTGAAGGATACCTT
TTTAGAGTTGCAATCAAATTTTACTAGGTTGATGCATTCTTAAAAGAGTT
TATACAATATCAAACATGATTAATCTTTCAAATAATTTTGACATATTTAT
CTTGAGGTTT SEQ ID NO:34.
Arabidopsis thaliana 1 (thale cress) AAK96469;
TCACCGAACCATTGATCTTCAAGTTCCGATCCAATTTCAGATATGTCGAG
GATTATTGGTACCGAGAAAACTCCGAGTGGCCGAAACAGAGATTTCGCAG
AGGAACCATCACTGATTGTGTCTTCAATCGAGAAAGGGCAAAATCGCGTG
ATTGATGCTTCGTTAACTCTTATTCGTGAAAGAAAAGGGATTAACTATAT
CCATAGACTAAATTCTGCGTCGTTCACGAGCGTATCTGCTCTTCTTGGTG
TACCACTTGGTCACAACTCTTCTTTTCTTCAAGGTCCTGCTTTTGCTCCT
AGGGCAAAACTCAAAGGAGAGTTAGTGCGTCTTTTAGGTGGAGCTAAAGC
TTCAACATCTGAGTTGAAGGATCCACGGGTTCTAACTGATGTTGGGGATG
TTCCGGTACAAGAGATTAGACCTCGTATTCGAGAAGCTATTTGGTGTGGT
AGCACAAACTCTGCCACTGAAGAAGGGAAGATGGAAGAGGAACCATTGCG
TCCGTTGGTCTTAGGTGGAGACCATTCCATATCTTATCCTGATTGTGGGG
TTGATGATGATAGACTGATGAATGTCATAAGTGAATCTGTGAAGTTGGTG
GTTGTGAGAGCGGTTCTGAGAAGCTTGGAGGGCCTGTGGACATTCTTCA
TCTTGATGCACATCCGGATATATATGACTGTTTTGAAGGAAATAAGTACT
CTCATGCATCTTCTTTTGCTCGTATCATGGAAGGTGGCTATGCGCGTAGG
CTTTTACAGGTTGGGATCAGATCGATAAACCAGGAAGGACGGGAACAAGG
CAAGAGGTTTGGAGTAGAACAGTATGAGATGCGAACCTTCTCGAAAGATC
GCCCAATGTTGGAAAATCTGAATTAGGGGAAGGAGTGAAGGGGTATAC
ATCTCGATAGACGTTGACTGTCTCGATCCGGCATTTGCACCTGGAGTGTC
GCATATCGAACCAGGAGGTCTCTCTTTCCGTGACGTCCTTAACATCTTAC
ACAACCTTCAGGCAGATGTTGTCGGGGCTGACGTTGTCGAGTTCAACCCG
CAGCGTGATACTGTTGACGGCATGACAGCAATGGTTGCAGCTAAGCTTGT
TAGAGAATTAGCTGCGAAAATCTCGAAATGAAACAGAATGGTAATTTTGG
AGTTTGTTTTTTGTTATGTTTCATCGTGCAAGTTTGTAACATTCATATAG GTTCTTGAATGCAATAAGTCTGGCTCCATAGACGGAGTATCAAACAAACA
TAATATGAATTCTGATCTAAGGCTATAAAATCAATGTTCATATGCG SEQ ID NO:35.
Arabidopsis thaliana 2 (thale cress) AY087307;
ACTTATACCTCACTGACTTACTACAAATCAGATATGTGGAAGATTGGGCA
GAGAGGAGTTCCCTATTTCCAGAGACTCATTGCTGCGCCGTTCACGACCT
TGCGGTCCTTGCCAACTTCTTTGGTCGAGACAGGGCAGAACCGTGTCATT
GATGCTTCGTTAACTCTCATCCGTGAAAGGGCAAAACTCAAAGGAGAGTT
AGTGCGACTCATAGGAGGAGCAAAAGCTACAACAGCTCTTCTTGGAGTAC
CACTTGGTCACAACTCTTCTTTTCTTGAAGGCCCAGCCTTGGCTCCTACT
CATGTAAGGGAAGCTATTTGGTGTGGTAGTACAAACTCCACCACTGAAGA
AGGGAAGGAGCTAAAAGATCCACGTGTTCTAAGTGATGTTGGGGATATTC
CGGTACAAGAGATTAGAGAAATGGGGGTTGATGATGATAGACTTATGAAT
GTAGTAAGTGAATCTGTGAAGCTGGTTATGGAAGAGGAACCATTGCGCCC
GCTGGTCATAGGTGGAGACCATTCCATATCTTATCCTGTTGTGAGAGCTG
TTTCGGAGAAACTTGGAGGACCCGTGGATATTCTTCATCTTGATGCACAT
CCCGATATATATGACCGTTTTGAAGGCAATTATTACTCTCATGCATCTTC
TTTTGCTCGTATCATGGAAGGTGGCTATGCGCGGCGGCTTTTACAGGTTG
GGATCAGATCCATAAACAAAGAAGGACGGGAACAAGGCAAGAGGTTTGGA
GTAGAACAGTATGAGATGCGAACCTTCTCAAAAGATCGCCAAATGTTGGA
AAACTTGAAACTAGGGGAAGGAGTGAAGGGCGTGTATATCTCGATCGATG
TTGACTGTCTCGATCCGGGATTCGCGCACGGAGTGTCCCACTTCGAACCA
GGAGGTCTTTCTTTCCGAGACGTCCTTAACATATTACACAACCTTCAGGG
AGATTTGGTGGGGCTGATGTTGTTGGGTACAATCCACAGCGTGATACCG
CTGATGACATGACGGCAATGGTCGCGGCTAAGTTTGTTAGAGAGCTAGCC
GCAAAAATGTCAAAATGAATTTAAATGGTACTTTGGAGTTTAATCGTTGA
AGCTTGTAATATGCAATAAGTGTGGTCTCATAGACATGGTATCGAATAAG
CTTAATATCAATTGGGTTTTAGGCCCAAATATCAATGTATAATTTATTA
AATTATGATAAGATGCATTGTAATAAGTTGTAAAAATAATTTATCATATT
GCAATATATGTAAACATTAATTTAGC SEQ ID NO:36.
Drosophila melanogaster (fruit fly):
GTCGTTGTTGTCTCATTCATTCCCGGCCTCGCAGTCGTGGATTTTACAGC
ATTGCGAGCAGATCCAATCTAAGAGATCCTAGATCACATGCAAAATGTGG
TGGAGCCGTAAATTTGCCTCAAGGTCTCTCCGCCTCCACCGGCTCAAGAG
CACCGGAAGCACTGCGCCCAGGGAACCTGAGCAATCTCTAGGCATCATTG
GAGTGCCCTTCGCAAAGGGGCAGGCCAAGCAGGGCGTGGAACTGGCGCCA
GATCTTCTCCGGCAGAGCAGTCTGCGTCAGGTGCTTCAGAGCAGTCATGA
TGGCCTGGTGATACGGGACTACGGAAATCTGCAGTACGCCGTAGACGAGC
CCCTTCTCCAGCAGCAGCGTGTGCACTATCACCACATCCGAAACTACGCG
GACTTCATGGCCTGCAATCGGGCACTGATTGAACAGGTGAAACTCATGCT
CGTGGAGAACACGCAGTTTTTAGCCATTGGTGGTGATCATGCGATCGGCT

TCGGATCCGTGGCCGGGCACCTGCAACACACGCCGAATTTGTCCCTGGTG

TGGATCGACGCACATGCGGACATCAATCTGCATAGCACCTCGCAGTCGGG

CAACATCCATGGGATGCCTGTATCCTTTCTGTTGGAACAGCTCCGTAACA

CCTGGCAGCACGCTGGCCTCCAGGAAATCGCGCCCAACTGCTTGCCCAAG

GATCAGCTGGTTTACATCGGACTCCGGGACATTGACCCCTACGAGGCGTT

CATCCTAAACAAAGTCGGAATACGCTACTATGCAATGGATACCATCGACC

GGGTGGGCGTGCCCAAGATTATCGAGATGACGCTGGACGCCCTTAATCCG

CAGAACAAGATCCACGTCAGCTTTGACATCGACGCCTTGGACAGCAATGT

GGCGCCTAGCACTGGCACCGCGGTGCGCGGTGGCCTCACGCTCCGCGAGG

GAATCAGCATCGTGGAGGCACTCCGGGACACCAAGCGGGTGCAGGGCGTC

GATCTGGTGGAGATCAACCCAAAGCTAGGCAGCGAGCGCGACGTGCGCAC

CACTGTGGAGTCCGGCCTGGAGATACTGAAGAGCATGTTCGGTTACCGGC

GTTCGGGGCGCTGGAGCAACATCGATACCGGAATCCTTGGTAGCGATTAA

AGAATGCAACACCCCCAGTTTTGAACTTATTCATATTTATGTACAGCATT

CGTGACATATTAGTGTGTGTTTTTTTTTCGTATCTTAATGAGAGAATACA

ATATTTGCGTAAAAAGAA

SEQ ID NO:37.
Danio rerio (zebra fish) BC056711;
TAGAAGCCGCACCGGGAGACAGACTGAGTTGTTAGTTTGGGAAAAACCTT

CTGTTTTGCGTCAGTAAATTATTTTATAATTATCCAGTCAGCATGGCGAT

GAGAGGACCACTGTCCAGACTACTGAAATCCACCTTGACTTCCTGCCAGC

AGAACAGATCACATTCTGTTGCCATTTTGGGAGCTCCGTTTTCCAAAGGA

CAGAAAAGGAGAGGGGTGGAGCATGGACCCAAAGCTATTCGGGATGCAGG

TCTGGTGGAAAGACTTTCAAATCTTGACTACCCTGTTCATGATTTCGGAG

ACCTGACCTTCAAGCATCTGGAAAAAGATGAGCACTTCATGCACGTGCCG

TTCCCACGCACAGTTGGACGTGCCAATCAGTTGCTCTCTGGAGCTGTGAG

TGGGGCGGTGGGAGCAGGACACACTTGCATCATGCTGGGGGGAGATCACA

GCTTAGCGATTGGCTCAGTGGAAGGCCATTCTCAGCAGTGTCCTGACCTG

TGTCTGATATGGGTGGACGCACATGCGGATATCAACACGCCTCTGACTTC

ACCTTGGGGAAACCTCCACGGCCAGTCTGTAGCTTTCTTACTAAAGGACC

TGCAGAACAAGATGCCCAAAGTTCCCGGATTTTCCTGGATGAAGCCGTTC

CTGTCTGCCAGAGATCTGGTGTACATTGGTCTTAGAGATGTGGATCCAGG

CGAGCATGTATTCCTAAAGACCCTGGGAATTCAGTACTTCTCCATGCGGG

ACATTGACAGAATGGGCATTCAGAGAGTAATGGAGGTCACTCTGGATCAC

CTCTTGGCAAGGAAGCAAAGGCCGATCCACCTGAGCTTTGACATTGATGC

TTTTGACCCATCGCTGGCTCCTGCCACTGGAACTCCAGTTAACGGCGGAC

TGACCTACAGAGGGCATCTACATAACAGAGGAGATCCACAACACAGGT

TTGCTGTCTGTGATGGATGTGGTTGAAGTGAACCCCACACTCGGAGCGGC

ACCTGAGGCTGTGGAAGCCACGACTAGTCTAGCCGTTGACATAGTTGCAT

CCGCTCTGGGCCAGACGCGTGAAGGCGCACACGTCTCCTTCCCGAAGATT

ACAGAACCAAAAGAAGACACTGAGCTGCGGCTGTAGAGCACACGATCATC

CTCATCAAAGACTCTGACAAACAAACCACTTTGCATTCCAAAGTCTAAAA

GAACAACACTGAAGGATTTGCAGAGACTGATCACCAGGCTAAAGGTTTAT

TATGAAGGGTTACTGTAGTCTTGAGCTATAAATGATACATTTTTAAAAAA

ATGTGACCTCACTGGAAAAGTGCTGCTTTGAGCAGAATGGTGAGATTTAT

TATATTACGTCTGCTACTAATTTTAGGTTTGTGTTAAAAATGACTGCTGA

GATCTGGATTCTATATATTTGAGGGCTGAACAGTACATGTTTTTAATGTT

TCGTCAGCTGTCATGGGATTAGTGGGTAACCTCGGATCACTCTCTGGGTA

TTACTGCAGGAAAAAATGACATAAAAGAAAGTATCTGAAGGATGAGGTGA

CGCTTTACTTTGGACTGTTTTCCTCTGGATTGAAACATGTTTGCACTTT

TGGACCAGAACTGGTTTTTATTGTATTTCTATATGTCTGTTGGTTTTGTA

TAGTAGGACTGCTTTAATGGCTAATCTAATCCTGTGGGTTTGGTTAGGTT

GAGACTCTTTTTTTTAAATAGTTTGTTTGAAGTAAGTTATTTTAGTAAGT

TTAATTTTTATTTAAATAAAAAAAAATCATGTATGAATGCAATTCATGCAT

CTTTTTCAGATCTGAATTCACCACCAGTACCGGTATCTTCCTAATAAGGG

TAGCTTGATTTGTTGCATTTCAATGTTCCACTAAAACTGTTTTGTTGCAA

TAAACTAATGTACTGGAGACAGAAAAAAAAAAAAAAAAAAAAAAAAAAAA

AA

SEQ ID NO:38.
Xenopus laevis (African clawed frog) Arg1-prov
BC043635:
CTTACAATGAGTAGCCAAGGAAAGACATCAGTTGGAGTCATTGGAGCCCC

ATTCTCCAAGGGACAGCCAAGAAGAGGAGTGGAAGAGGGGCCTAAATATT

TAAGAGAGGCCGGGTTAATTGAGAAATTAAGAGAATTTGGCAATGATGTT

CGAGATTGTGGGGATTGGATTTTCCTGATGTGCCTAATGACACACCATT

TAACAATGTGAAAAACCCACGTACAGTTGGGAAAGCTACAGAAATATTGG

CCAATGCTGTCACAGCAGTAAAGAAAGCTGACAAGACATGCCTAACCATT

GGGGGAGATCACAGCTTGGCAGTGGGAACGATTGCCGGTCACGCAGCAGT

TCACCCTAATCTCTGTGTTGTGTGGGTGGATGCCCATGCAGATATCAACA

CTCCGTCCACATCACCCAGTGGCAACCTTCATGGACAGCCGTTATCTTTT

TTAATGAAAGAACTCAAAAGCAAGATGCCGGCTGTTCCAGGATTTGAGTG

GGTGAAACCATGTCTCCGTAGCAAAGACATTGTATACATCGGCTTAAGAG

ATGTGGACCCAGGAGAGCATTACATTCTGAAGACACTTGGTATAAAATAC

TATTCAATGTCTGAAGTGGATTATCTTAAAATAGACAAAGTAATGGAAGA

GACACTTGAATATTTGGTTGGCAAGCATAAGAGACCCATTCATTTAAGTT

TTGACATTGATGGACTGGACCCAAGCATAGCCCCAGCTACTGGAACCCCT

GTGCCTGGAGGACTGACTTACAGGGAAGGCATGTACATCACAGAACAACT

TCACAAAGAGGTTTACTTTCAGCAGTGGACATTATGGAGGTGAACCCAT

CGCGCGGAGAAACTAAGCGAGACGTTGAGGTCACAGTTAAAACTGCTCTT

GATATGACTTTGTCATGCTTTGGGAAAGCACGCGAAGGATTTCATGCATC

GACCATGATGCTTCCAGATATTTTCTAATTACACAATATTGTATATAGCA

AGTGTACAAATAAAGCACTCGGGATGAAGCACACAATTTGACTAGTCCCA

TTTTAAAAAAAAAATGCATTTTACACCTTCAAAAACAAATATGATTTAAAG

-continued

GGGATGTACAGCTTAAAATTAACATATGATACGATTGTTCAGATACAGTT

GTCCATTATATTTGGAAATGATCTATCTGCTGCTTTTGCAATGTTCAAAG

TCTACAACTGAGGTTTGGAATTCGCTAGATTCCCAGTTACCATAACAATT

TATTATTTATCTCTGACGAATCCTCATTTTCTCTGCTGGCATATACAGCC

AATCAAGCCTTCTACACCTCATATGTATTTTGCACTGGCGCCCACTGTAT

CAGCCTGCATCAAATTTTGGTATCAAAATCTGCTCAGAACGAGTGTCTGT

CAATACACAGATATACATACATACATACATACATGGGATTGGAAGGCAGC

TGATTGGCTTCTCCTGTGTGCCATTAGACACATATAGGTTAAATAGTAGC

CAGAACATGCTTTACTTTTTGTTAAATATGAAATTGCATATTTTTAAAAA

TCAATATGATTATATTAAGCTGGCAAGGCAGTGTTTTCACATTAGTACAA

TTATCTCTGCTTTAAATGAAATGTGACTCCTAAGGAATGTGTAATTTACT

CTGAAGCTGTGTAAATTCTATATTTTTAATAAACATTTATGTTGAAATAA

AAAAAAAAAAAAA

SEQ ID NO:39.
*Gallus gallus* putative agmatinase AF401291:
CGGACGCGTGGGCGGACGCGTGGGCGGCAGGGTGACACAGTGAGCCGCCT

GGCTGTGTTCCCAGCTGCAGGGACGGGGCAGGCTTTGGGGTCTCGCTGTG

TGTGTGGCAGGATGATTTGTCTGCTCAGGACAGCCAGGCTCTCTGCTCGG

TTGCTTTTTGCATCCGCTGCCGCTCCGTGCCGCCGTGCCTCGCGGTTCAA

CGTGCCTCCCAGTGCTGAGTTCGTGGCCCGGCCCGTGGGGTCTGCTCCA

TGCTGAGGCTTCCTGTTCAGACTTCAGCAGAGGGGCTGGATGCGGCTTTT

GTCGGCGTTCCCCTTGACACGGGCACATCCAACCGGCCTGGAGCCAGGTT

CGGTCCGCAGCAGATCCGTGCTGAGTCAGTGATGGTGAGGAGGTACAACG

CCAGCACCGGGGCAGCGCCCTTTGACTCCCTGCTGGTGGCCGATGTTGGA

GATGTAAATGTCAACCTCTACAACCTGCCCGACAGCTGCCGCCGCATCCG

TGAGTCCTACCAGAAGATCGTGGCCTCTGGCTGCGTGCCTCTCACTCTGG

GTGGAGACCACAGCATAACATACCCCATCCTGCAGGCAGTGGCAGAAAAG

CATGGCCCTGTGGGGCTGGTGCATGTGGACGCTCACACTGACACCAGCGA

CATGGCTCTGGGGGAGAAGATCTACCATGGGACCCCATTCCGGCGCTGCG

TGGATGAAGGGCTGCTGGACTGCAGCCGTGTGGTTCAGATTGGAATCCGT

GGCTCCTCCTATGCCCCCAATCCATACAAGTACTGCTGGGACCAGGGATT

CCGGGTGGTTCCAGCTGAGGAGTGCTGGATGAAGTCCCTGGTTCCACTGA

TGGGAGAGGTGAGGCAGCAGATGGGGATGGCCCAGTGTACATCAGCTTT

GATATCGATGGGCTGGACCCCGCCTACGCCCCGGGAACGGGGACACCAGA

GATTGCTGGGCTCACACCCATGCAGGCTTTGGAGATTATTCGTGGCTGCA

AAGGACTCAATATAGTGGGATGTGACCTTGTGGAGGTGGCACCCATATAT

GATGTCTCTGGTAACACTGCCCTGTTAGGGGCCAATCTGCTCTTTGAAAT

GTTGTGTGTCCTTCCTGGAGTGAAAACAATGTGAGGGCAGCTCCTGCCTG

GCCCCCAACCTTGCACAGCAGTGTACCGCCACCAGCAGATGCCATCACAG

ACCTTGGATGAGGTTCCTGATGCCCTGCTCTCCTCCAGGTGCAGTGATCG

TGTGCTTTGCAGTAAGGAATAAATGCTGCTAGGAGAGGTAGTGAAGCACA

GCAGCTGGGGAGAGCTGGGTGTCCTTTGGCCCAGCCGTTGGTGTTCCAGG

AGGGGTTTGGTTGCCCTTGGGATGTGTGAGTTGGTGCAGACACGGGTCT

ATATTTGGCACATGGAAACACAAAAGCCACCTCATCACACATTAAAATAG

TTTATTTCGGTTGAAAAAAAAAAAAAAAAAAAAAAAAAAAAAAAAAAAA

AAAAAAAAAA

SEQ ID NO:40.
*Rattus norvegicus* (Norway rat) type I arginase
NM_017134:
CTCAGCTGCAGGAACCCTGGATGAGCATGAGCTCCAAGCCAAAGCCCATA

GAGATTATCGGAGCGCCTTTCTCTAAGGGACAGCCTCGAGGAGGGGTAGA

GAAAGGTCCCGCAGCATTAAGGAAAGCTGGCCTGGTGGAGAAGCTTAAAG

AAACAGAGTACAATGTGAGAGACCACGGGGATCTGGCCTTTGTGGATGTC

CCCAATGACAGCCCCTTTCAAATTGTGAAGAACCCACGGTCTGTGGGAAA

AGCCAATGAACAGCTGGCTGCTGTGGTAGCAGAGACCCAGAAGAATGGAA

CAATCAGTGTGGTGCTGGGTGGAGACCACAGTATGGCAATTGGAAGCATC

TCTGGCCACGCCAGGGTCCACCCTGACCTATGCGTCATTTGGGTGGATGC

TCACACTGACATCAACACTCCGCTGACAACCAGCTCTGGGAATCTGCACG

GGCAACCGGTGGCCTTTCTCCTGAAGGAACTGAAAGGAAAGTTCCCAGAT

GTACCAGGATTCTCCTGGGTGACCCCCTGCATATCTGCCAAGGACATCGT

GTACATCGGCTTGCGAGATGTGGACCCTGGGGAACACTATATAATAAAAA

CTCTGGGCATTAAGTATTTCTCAATGACTGAAGTGGACAAGCTGGGAATT

GGCAAAGTGATGGAAGAGACCTTCAGCTACCTGCTGGGAAGGAAGAAAAG

GCCCATTCACCTGAGTTTTGATGTTGATGGACTGGACCCAGTATTCACCC

CGGCTACGGGCACACCCGTTGTGGGAGGCCTATCTTACAGAGAAGGTCTC

TACATCACAGAAGAAATTTACAAGACAGGGCTACTTTCAGGACTAGATAT

CATGGAAGTGAACCCAACTCTTGGGAAGACACCAGAGGAGGTGACTCGTA

CTGTGAACACGGCAGTGCCGTTGACCTTGTCTTGTTTTGGAACGAAACGG

GAAGGTAATCATAAGCCAGAGACTGACTACCTTAAACCACCGAAATAAAT

GTGAATACATCGCATAAAAGTCATCTGGGGCATCACAGCAAACCGAACAG

AACCAGGCCAACGCTGCTCCTCCCAAGGGCTTGTTCTTTTAGAAAAAGA

ATGTTTTTTCCCAATATGTATGTATTCTAGCAGTTCCTTTCTGGAATGAA

ATTCAGGGTGTGGGAATTAAAACAGCTATGAAATTAGGAGACACGTACTT

CCCATTTTAGCAGAAGTTATCCTTAAGAAGTAGTATAAATTAATATCTAA

TTAAAAAATGCACCAGGAGTTAAAATACACAGTGATGTCAAGTGTCAACT

CACGGTTGGAAGCAAAGGCATCTGGAGACGAGGCCTGCATCCACGTCGTT

CAAAACATGTGATTTTTGTAATAAACTCTTTATAAT

SEQ ID NO:41.
*Rattus norvegicus* (Norway rat) arginase type II
NM_019168:
CGCGCTTGCCTAGTGAAGCTGCGAACGTGTGGGAGGCTGCACTCACTCGA

GGTCCTGAGTTGCGCGGAGCTGCTTCTGCTAGGGCGATCGCCTCCCTGCA

ATCATGTTCCTGAGGAGCAGCGTCTCCCGTCTCCTCCACGGGCAAATTCC

TTGTGCCCTGACGAGATCCGTCCACTCTGTAGCTGTAGTCGGAGCCCCTT

TCTCTCGGGGACAGAAAAAGAAAGGAGTGGAATATGGCCCAGCCGCCATC

CGAGAAGCTGGCTTGCTGAAGAGGCTTTCTATGTTGGGATGCCATATAAA

AGACTTTGGAGACTTGAGTTTTACTAACGTTCCCAAAGATGATCCCTACA

ATAATCTGGTCGTGTATCCTCGCTCAGTGGGCATTGCCAACCAGGAACTG

GCTGAGGTGGTTAGTAGAGCTGTGTCAGGTGGCTACAGCTGTGTCACACT

GGGAGGAGACCACAGCCTGGCAATCGGTACCATTAGTGGCCATGCCCGAC

ACCACCCAGATCTCTGTGTCATCTGGGTTGATGCTCATGCTGACATTAAT

ACACCCCTCACCACTGTATCAGGAAATATCCATGGGCAGCCTCTTTCCTT

TCTCATCAGAGAACTACAAGACAAGGTACCACAACTGCCAGGATTTTCCT

GGATCAAACCTTGCCTCTCTCCCCCAAATCTTGTATACATTGGCTTACGA

GATGTGGAGCCTGCCGAACACTTTATTTTAAAGAGTTTTGACATCCAGTA

TTTCTCCATGAGAGATATTGATCGACTTGGTATCCAGAAGGTCATGGAAC

AGACATTTGATCGGCTGATTGGCAAGAGGAAGAGGCCGATCCACCTGAGC

TTTGACATAGATGCATTTGACCCTAAGCTGGCTCCAGCCACAGGAACCCC

TGTGGTAGGGGGGCTGACCTACAGAGAAGGACTGTACATTACTGAAGAAA

TACATAGCACAGGGTTGCTGTCGGCTCTGGATCTTGTTGAAGTCAATCCT

CATTTGGCCACTTCTGAGGAAGAGGCCAAGGCTACAGCCAGCCTAGCAGT

GGATGTGATTGCTTCAAGTTTTGGTCAGACAAGAGAAGGCGGACACATTG

CCTATGACCACCTTCCTACTCCTAGTTCACCACATGAATCAGAAAAGGAA

GAATGTGTGAGAATTTAGGAAACACTGTACTCTGGCACCTTTCACGACAG

CATTCCAGAGTTGGGAGGCATTTAAAGGGACAAAGAGTAAATGGCTGTCT

GGATCCAATATTGCCTTAATGAGAACATCTGTGCACTCTCACAAGTGTAG

AGTCCCCTTCTCTATTTTGGTCACAATACTATCACTGTAAATGTATCTGT

TGGGTTTTTGTTTCTGAAGTTTACAAGCTATTGTTATTATACACGTGTGT

TTGAAGGAGTCATAAACAGCATTTATTACCTTAAAAAAAAAAAAAAAAAA

AAAAAAAAAAAAA

SEQ ID NO:42.
Mus musculus (house mouse) arginase 1, liver,
BC050005:
TGATTATAAGGGGGGAAAAAGATGTGCCCTCTGTCTTTTAGGGTTACGGC

CGGTGGAGAGCAGCTGGACAGCCCGAGCATATGCAGCAGCAGCAGCCACT

GGAACCCAGAGAGAGCATGAGCTCCAAGCCAAAGTCCTTAGAGATTATCG

GAGCGCCTTTCTCAAAAGGACAGCCTCGAGGAGGGGTAGAGAAAGGCCCT

GCAGCACTGAGGAAAGCTGGTCTTCTGGAAAAACTTAAAGAAACAGAGTA

TGACGTGAGAGACCACGGGGACCTGGCCTTTGTTGATGTCCCTAATGACA

GCTCCTTTCAAATTGTGAAGAACCCACGGTCTGTGGGGAAAGCCAATGAA

GAGCTGGCTGGTGTGGTGGCAGAGGTCCAGAAGAATGGAAGAGTCAGTGT

GGTGCTGGGTGGAGACCACAGTCTGGCAGTTGGAAGCATCTCTGGCCACG

CCAGGGTCCACCCTGACCTATGTGTCATTTGGGTGGATGCTCACACTGAC

ATCAACACTCCCCTGACAACCAGCTCTGGGAATCTGCATGGGCAACCTGT

GTCCTTTCTCCTGAAGGAACTGAAAGGAAAGTTCCCAGATGTACCAGGAT

TCTCCTGGGTGACTCCCTGCATATCTGCCAAAGACATCGTGTACATTGGC

TTGCGAGACGTAGACCCTGGGGAACACTATATAATAAAAACTCTGGGAAT

TAAGTATTTCTCCATGACTGAAGTAGACAAGCTGGGGATTGGCAAGGTGA

TGGAAGAGACCTTCAGCTACCTGCTGGGAAGGAAGAAAAGGCCGATTCAC

CTGAGCTTTGATGTCGACGGGCTGGACCCAGCATTCACCCCGGCGACCGG

CACCCCGGTTCTGGGAGGCCTATCTTACAGAGAAGGTCTCTACATCACAG

AAGAAATTTACAAGACAGGGCTCCTTTCAGGACTAGATATCATGGAAGTG

AACCCAACTCTTGGGAAGACAGCAGAGGAGGTGAAGAGTACTGTGAACAC

GGCAGTGGCTTTAACCTTGGCTTGTTCGGAACTCAACGGGAGGGTAACC

ATAAGCCAGGGACTGACTACCTTAAACCACCTAAGTGACTGTGAATGCGC

CACATGAAAACCATCTGGGGCATCACAGCAAAGCAGACAGAGCTAAGCAA

ACGCCTTCTCCTCCCAAGGGCTTGTTCTTTTAGAAAAAAAAAAAAAA

SEQ ID NO:43.
Mus musculus 2 (house mouse) Arginase typeII
BC023349:
GTTGCACCGAGCCGGTTCTCCTAGGGTAATCCCCTCCCTGCCAATCATGT

TCCTGAGGAGCAGCGCCTCCCGTCTCCTCCACGGGCAAATTCCTTGCGTC

CTGACGAGATCCGTCCACTCTGTAGCTATAGTCGGAGCCCCTTTCTCTCG

GGGACAGAAGAAGCTAGGAGTGGAATATGGTCCAGCTGCCATTCGAGAAG

CTGGCTTGCTGAAGAGGCTCTCCAGGTTGGGATGCCACCTAAAAGACTTT

GGAGACTTGAGTTTTACTAATGTCCCACAAGATAATCCCTACAATAATCT

GGTTGTGTATCCTCGTTCAGTGGGCCTTGCCAACCAGGAACTGGCTGAAG

TGGTTAGTAGAGCTGTGTCAGGTGGCTACAGCTGTGTCACCATGGGAGGA

GACCACAGCCTGGCAATAGGTACCATTATCGGTCACGCCCGGCACCGCCC

AGATCTCTGTGTCATCTGGGTTGATGCTCATGCGGACATTAATACACCTC

TCACCACTGTATCTGGAAATATACATGGACAGCCACTTTCCTTTCTCATC

AAAGAACTACAAGACAAGGTACCACAACTGCCAGGATTTTCCTGGATCAA

ACCTTGCCTCTCTCCCCAAATATTGTGTACATTGGCCTGAGAGATGTGG

AGCCTCCTGAACATTTTATTTTAAAGAATTATGACATCCAGTATTTTTCC

ATGAGAGAGATTGATCGACTTGGGATCCAGAAGGTGATGGAACAGACATT

TGATCGGCTGATTGGCAAAAGGCAGAGGCCAATCCACCTGAGTTTTGATA

TTGATGCATTTGACCCTAAATTGGCTCCAGCCACAGGAACCCCTGTTGTA

GGGGGATTAACCTACAGAGAAGGAGTGTATATTACTGAAGAAATACATAA

TACAGGGTTGCTGTCAGCTCTGGATCTTGTTGAAGTCAATCCTCATTTGG

CCACTTCTGAGGAAGAGGCCAAGGCAACAGCCAGACTAGCAGTGGATGTG

ATTGCTTCAAGTTTTGGTCAGACAAGAGAAGGAGGACACATTGTCTATGA

CCACCTTCCTACTCCTAGTTCACCACACGAATCAGAAAATGAAGAATGTG

TGAGAATTTAGGAAATACTGTACTCTGGCACCTTTCACAACAGCATTCCA

GAGTTGCAAGGCATTCGAAGGGACAGATATGAAATGGCTGTCTGGATCAA

TATTGCCTTAATGAGAACATCTGTGCACTCTCACAACTGTAAAACTCCCT

TCTCTATTTTGGTCACCAACACTATTACTGTAAATGTATTTTTTGTTGTT

TTTGAAGTTTACAAGCTATTAATGTTATACATGTAAGTTTGAAGGAGTCA

TAAACAACATTTATTACCTTAGTATATCATAAAAAAAAAAAAAAA

SEQ ID NO:44.
Sus scrofa arginase I mRNA AY039112:
CCACGCGTCCGCGGACTCATGGTCATTCCAGGTATGAACTTGCTGGGCTT
CCACCTGACTGTGTCTTCCGTTCAGTAGGTGGAGCCACTCTTCCTCATTA
GAATAAAGTCAACAGATTGAACTCAATTATAAATAGGAAAAAAATGTGC
CCTTGGCCACTGAGTGTTGCTGAGAGGGAAGACTGGCTGGAGGACTCTGG
TGTAGCGGTGAGAAATATTGGAGCATGAGTTTCAAGTCACAATCCATCGG
GATCATCGGAGCTCCTTTCTCCAAGGGTCAGCCACGAGGAGGGGTGGAAG
AAGGCCCTACAGCATTGAGAAAGGCTGGTCTGCTTGAGAAACTTAAAGAA
CAAGAGTGTGATGTGAAAGATTACGGGGACCTGTGCTTTGCTGATGTCCC
TAATGACACTCCCTTTCAAATAGTGAAGAATCCAAGGTCTGTGGGAAAAG
CAAATCAACAGCTGGCTGATGTGGTGGCAGAAATCAAGAAGAACGGAAGG
ACCAGCCTTGTACTGGGCGGAGACCACAGTATGGCGATTGGCAGCATCTC
TGGCCATGCCAGGGTCCACCCAGATCTCTGTGTCATTTGGGTGGATGCTC
ACACCGACATCAACACTCCACTGACAACCACGACCGGGAACTTACATGGA
CAGCCTGTGTCTTTTCTCCTGAAGGAACTAAAGGAAAAGATTCCCGAGGT
CCCAGGACTTTCCTGGGTGACTCCCTGCCTATCTGCCAAAGATATTGTGT
ATATTGGCCTGAGAGACGTGGACCCTGCAGAACACTATATTTTGAAAACT
CTGGGCATTAAATACTTTTCAATGATTGAAGTGGATAAGCTGGGAATTGG
CAAGGTGATGGAAGAAGCATTCAGCTATCTACTAGGAAGAAAGAAAGGC
CAATTCATTTGAGCTTTGATGTGGATGGACTGGATCCATTTTTCACACCG
GCCACTGGCACACCAGTCCATGGAGGTCTGTCTTATAGAAGGTATCTA
CATCACGGAAGAAATTTACAAAACAGGGCTACTGTCAGGATTAGATATCA
TGGAAGTGAATCCATCTCTGGGGAAGACACCAGAAGAAGTAACTCGGACG
GTGAACACGGCAGTAGCACTGGTCTTGGCTTGTTTTGGAGTTGCTCGGGA
GGGTAACCATAAGCCTATTGATTACCTGAAACCACCTAAGTAAATGGAAA
CATTACATGAAAATCTCACAGCTGATGACATAATTAGCAAATCTAACAGT
TTAGTTAAACTTACAGTTATCTTCCCGATTGGACTTTCAGAAAAATGTTT
TGCCCTGGTAAATATGAGTACCATTAGTATAAACTGTATCAATTCCCTCT
TGGTGTGAAAATCAAGATATGGAACTGCTAGCTTTTGTGAAATTAAAAAA
CTTATTATTCCCAAAAAAAAAAAAAAA SEQ ID NO:45.
Homo sapiens 1 (human) arginase (EC3.5.31) M14502:
TCACTGAGGGTTGACTGACTGGAGAGCTCAAGTGCAGCAAAGAGAAGTGT
CAGAGCATGAGCGCCAAGTCCAGAACCATAGGGATTATTGGAGCTCCTTT
CTCAAAGGGACAGCCACGAGGAGGGGTGGAAGAAGGCCCTACAGTATTGA
GAAAGGCTGGTCTGCTTGAGAAACTTAAAGAACAAGAGTGTGATGTGAAG
GATTATGGGGACCTGCCCTTTGCTGACATCCCTAATGACAGTCCCTTTCA
AATTGTGAAGAATCCAAGGTCTGTGGGAAAAGCAAGCGAGCAGCTGGCTG
GCAAGGTGGCACAAGTCAAGAAGAACGGAAGAATCAGCCTGGTGCTGGGC
GGAGACCACAGTTTGGCAATTGGAAGCATCTCTGGCCATGCCAGGGTCCA
CCCTGATCTTGGAGTCATCTGGGTGGATGCTCACACTGATATCAACACTC CACTGACAACCACAAGTGGAAACTTGCATGGACAACCTGTATCTTTCCTC
CTGAAGGAACTAAAAGGAAAGATTCCCGATGTGCCAGGATTCTCCTGGGT
GACTCCCTGTATATCTGCCAAGGATATTGTGTATATTGGCTTGAGAGACG
TGGACCCTGGGGAACACTACATTTTGAAAACTCTAGGCATTAAATACTTT
TCAATGACTGAAGTGGACAGACTAGGAATTGGCAAGGTGATGGAAGAAAC
ACTCAGCTATCTACTAGGAAGAAAGAAAGGCCAATTCATCTAAGTTTTG
ATGTTGACGGACTGGACCCATCTTTCACACCAGCTACTGGCACACCAGTC
GTGGGAGGTCTGACATACAGAGAAGGTCTCTACATCACAGAAGAAATCTA
CAAAACAGGGCTACTCTCAGGATTAGATATAATGGAAGTGAACCCATCCC
TGGGGAAGACACCAGAAGAAGTAACTCGAACAGTGAACAGAGCAGTTGCA
ATAACCTTGGCTTGTTTCGGACTTGCTCGGGAGGGTAATCACAAGCCTAT
TGACTACCTTAACCCACCTAAGTAAATGTGGAAACATCCGATATAAATCT
CATAGTTAATGGCATAATTAGAAAGCTAATCATTTTCTTAAGCATAGAGT
TATCCTTCTAAAGACTTGTTCTTTCAGAAAAATGTTTTTCCAATTAGTAT
AAACTCTACAAATTCCCTCTTGGTGTAAAATTCAAGATGTGGAAATTCTA
ACTTTTTTGAAATTTAAAAGCTTATATTTTCTAACTTGGCAAAAGACTTA
TCCTTAGAAAGAGAAGTGTACATTGATTTCCAATTAAAAATTTGCTGGCA
TTAAAAATAAGCACACTTACATAAGCCCCCATACATAGAGTGGGACTCTT
GGAATCAGGAGACAAAGCTACCACATGTGGAAAGGTACTATGTGTCCATG
TCATTCAAAAAATGTGATTTTTTATAATAAACTCTTTATAACAAG SEQ ID NO:46.
Homo sapiens 2 nonhepatic arginase D86724:
GATTCTCAGTGCTGCGGATCATGTCCCTAAGGGGCAGCCTCTCGCGTCTC
CTCCAGACGCGAGTGCATTCCATCCTGAAGAAATCCGTCCACTCCGTGGC
TGTGATAGGAGCCCCGTTCTCACAAGGGCAGAAAAGAAAGGAGTGGAGC
ATGGTCCCGCTGCCATAAGAGAAGCTGGCTTGATGAAAAGGCTCTCCAGT
TTGGGCTGCCACCTAAAAGACTTTGGAGATTTGAGTTTTACTCCAGTCCC
CAAAGATGATCTCTACAACAACCTGATAGTGAATCCACGCTCAGTGGGTC
TTGCCAACCAGGAACTGGCTGAGGTGGTTAGCAGAGCTGTGTCAGATGGC
TACAGCTGTGTCACACTGGGAGGAGACCACAGCCTGGCAATCGGTACCAT
TAGTGGCCATGCCCGACACTGCCCAGACCTTTGTGTTGTCTGGGTTGATG
CCCATGCTGACATCAACACACCCCTTACCACTTCATCAGGAAATCTCCAT
GGACAGCCAGTTTCATTTCTCCTCAGAGAACTACAGGATAAGGTACCACA
ACTCCCAGGATTTTCCTGGATCAAACCTTGTATCTCTTCTGCAAGTATTG
TGTATATTGGTCTGAGAGACGTGGACCCTCCTGAACATTTTATTTTAAAG
AACTATGATATCCAGTATTTTTCCATGAGAGATATTGATCGACTTGGTAT
CCAGAAGGTCATGAACGAACATTTGATCTGCTGATTGGCAAGAGACAAA
GACCAATCCATTTGAGTTTTGATATTGATGCATTTGACCCTACACTGGCT
CCAGCCACAGGAACTCCTGTTGTCGGGGGACTAACCTATCGAGAAGGCAT
GTATATTGCTGAGGAAATACAACATCAGGGTTGCTATCAGCACTGGATC
TTGTTGAAGTCAATCCTCAGTTGGCCACCTCAGAGGAAGAGGCGAAGACT

ACAGCTAACCTGGCAGTAGATGTGATTGCTTCAAGCTTTGGTCAGACAAG

AGAAGGAGGGCATATTGTCTATGACCAACTTCCTACTCCCAGTTCACCAG

ATGAATCAGAAAATCAAGCACGTGTGAGAATTTAGGAGACACTGTGCACT

GACATGTTTCACAACAGGCATTCCAGAATTATGAGGCATTGAGGGGATAG

ATGAATACTAAATGGTTGTCTGGGTCAATACTGCCTTAATGAGAACATTT

ACACATTCTCACAATTGTAAAGTTTCCCCTCTATTTTGGTGACCAATACT

ACTGTAAATGTATTTGGTTTTTTGCAGTTCACAGGGTATTAATATGCTAT

AGTACTATGTAAATTTAAAGAAGTCATAAACAGCATTTATTACCTTGGTA

TATC

SEQ ID NO:47.
Saccharomyces cerevisiae (baker's yeast) TIGR unigene TC13988 (GenBank M10110):
ATGGAAACAGGACCTCATTACAACTACTACAAAAATCGCGAATTGTCCAT

CGTTCTGGCTCCATTCAGCGGCGGTCAGGGTAAGCTTGGTGTCGAGAAGG

GCCCTAAATACATGCTTAAGCATGGTCTGCAAACAAGCATAGAGGATTTG

GGCTGGTCTACGGAATTAGAGCCCTCAATGGACGAGGCCCAATTTGTGGG

AAAGTTGAAAATGGAGAAGGACTCCACAACTGGGGGTTCCTCTGTTATGA

TAGACGGTGTCAAGGCTAAAAGAGCAGATTTGGTTGGTGAAGCCACCAAG

TTGGTGTACAACTCCGTGTCGAAAGTGGTCCAGGCGAACAGATTCCCCTT

GACCTTGGGTGGTGATCATTCAATAGCCATTGGTACTGTATCCGCGGTTT

TGGACAAATACCCCGATGCTGGTCTTTTATGGATAGACGCCCACGCTGAT

ATAAACACCATAGAAAGCACCCCCTCTGGAAACTTGCACGGCTGTCCCGT

GTCATTCCTAATGGGTTTGAACAAGGATGTCCCACATTGTCCCGAGTCGC

TCAAATGGGTTCCAGGCAACTTGAGCCCAAAAAGATCGCGTATATTGGG

TTGAGAGATGTTGATGCCGGAGAAAAGAAAATCTTGAAAGATCTGGGTAT

CGCCGCCTTTTCCATGTACCACGTTGACAAATACGGCATCAACGCTGTCA

TTGAAATGGCAATGAAAGCCGTGCACCCAGAAACAAACGGTGAAGGTCCC

ATTATGTGCTCCTATGACGTCGATGGTGTAGACCCATTATACATTCCTGC

TACAGGTACTCCAGTGAGAGGTGGGTTGACCTTGAGAGAAGGTCTTTTCT

TGGTGGAAAGATTGGCCGAATCCGGTAATTTAATTGCGCTAGACGTTGTT

GAATGTAACCCTGATCTGGCTATTCATGATATCCATGTTTCAAACACCAT

CTCTGCAGGTTGCGCCATTGCAAGGTGTGCATTGGGTGAAACCTTATTGT

AGTTTATATCATCATCCCTTTTATCAAAATAAGCATTCTCTTTTATTTT

AGTTAAGNACATGCATACATAAATTTACGAAC

SEQ ID NO:48.
Agrobacteriumtume faciens 2 X15884 (CAA33894):
GTCGACACATGAGTGATCGTTCGGCCATCGCAACTGTGCGGTGACCAAAG

TTGCAGTCAAGAAATGAACGGTGCTGGCGAAATCAACGCTTCGCGGCATC

GCAAGGAGAATGAGTTGAAGACGTGCCAAATCCTGGGAGCTCCCGTTCAA

AGTGGCGCATCCCAACCCGGATGCCTGATGGGACCTGATGCGTTTCGGAC

TGCCGGCTTGACGCAAGTTCTGACGGAGCTGGGCTGGGCTGTCACCGATC

TCGGAGATGCGACACCAACGGTCGAACCCGAACTCAGCCACCCCAATTCC

GCGGTGAAGAACCTCGATGCTCTGGTGGGATGGACGCGCAGTCTGTCCCA

GAAAGCTCTGGAGATGGCCCGCAGCTGCGATCTTCCGGTCTTTCTCGGCG

GCGATCACTCGATGTCTGCTGGCACCGTCTCAGGTGTGGCCCAACGTACA

GCCGAGCTTGGCAAGGAGCAATTCGTCCTTTGGCTGGACGCGCATACGGA

CCTGCATACCCTCCACACGACCGCGAGCGGCAATCTCCACGGCACACCCG

TAGCCTACTATACGGGCCAATCCGGCTTCGAAGGGCTGCCGCCGCTGGCC

GCGCCTGTAAATCCCCGCAACGTATCCATGATGGGGATTCGCTCAGTCGA

TCCGGAAGAGAGGCGACGGGTTGCCGAGATCGGTGTTCAAGTCGCTGACA

TGCGGGTTCTGGACGAACAAGGGGTCGTACGCCCGCTCGAAGCTTTTCTT

GACCGCGTGAGTAAGGTCAGCGGCAGATTGCACGTCAGCCTTGATGTCGA

TTTCCTCGATCCCGCGATCGCGCCAGCAGTGGGCACGACCGTTCCTGGCG

GAGCGACCTTCCGGGAAGCGCACCTCATCATGGAGATGCTCCATGACAGC

GGCCTTGTCACGTCACTCGACCTGGCGGAGCTCAATCCGTTTCTGGATGA

GAGGGGGCGCACTGCCCGCCTCATAACCGATCTTGCCTCGAGCCTATTCG

GCCGGCGCGTGTTCGACAGGGTGACAACAGCATTTTGATCACCGGGTGTT

GCCCGGTGCGATCGAGGTTTGCCTCTCGCACCGAGACAAA

SEQ ID NO:49.
Schistosoma japonicum AY336494 (AAQ16108):
ACAAGTAAAAATGTTGAAATCCGTTGCAACCCCTTATTATCCTGTTCAAA

ATGGTGAAACACCTAAGCTTTTATATCCACATGTCAATTTCTTGGGTATA

CCTGTTAACAAAGGGCAACCAAAACTTGGTACATATCAGGGACCAGATTT

TATTAGAAAATCTAACTTCTTCCAGCTTGTAGCTGAAGATGGAATCCAAA

TAACCGACTGTGGAGATGTCATACCTGTAGAACTAAGTGAATCAGAGGAT

CCAGAACGTTGTGGAATGAAATGGTCAAGAAGTTTCACACAGACCACTTT

GAAAATAGCTGACCGTGTAGAACAGTTGGTAAAAGGGTCAAATAAACATA

GTATTGAATCCAGTAATTCGAAACCATCACCATTAGTAATTGTTGGCGGT

GATCATAGTATGGCGACTGGAACTATACTTGGACATGCTAGAGCCAAACC

AGATGTGTGCATTATATGGGTTGATGCTCATGGTGATATAAATACACCAC

CAAACTCAACTACTGGAAATATACATGGAATGCCGTTAAGTTTTCTAGTA

AAAGAACTACAAGATCAAATTCCATGGTTGGATGACTTTCATAGTATAAA

ACCATGTCTGGATGCCAGCAATCTTGTTTACATTGGTTTACGGGATTTAG

ACGTTTATGAAACACGGGATATAAGAAAGCATGCTATAGCTTATTTTACA

ATGCTTGACGTTGATCGAATGGGAATGGAAGCCGTCATTAAAGAAGCATT

ACAAGCTGTGAATCCGAGATTAGAGAAACCTATTCATTTAAGTTTTGATA

TTGATGCATTGGATCCTTCAATTGCTCCAAGTACTGGTACTGCTGTTCCA

GGTGGTTTAACATTACGTGAAGGTTTAAGAATATGTGAAGAAATTTCAGC

TACAGGAAAACTTTCTATTGTTGAATTGGCTGAATTAAATCCTTTGTTAG

GATCTAAAGAGGATGTTGAAAAAACGCAATCATCTGCTGTGCACATTTTA

AGGGCATCGTTAGGACATTGTCGTTCAGGTCAATTACCGATGAAAGTTAA

CAATTCAACCACTAATACCATTGTTAGACAAGCTGAACGTATACAGATAA

AGTGATAATTATTCTTTCTTCAATAGCAATTAATTGATTTAATTCTTATA

ATAATATAATTCAATGATCAATATGATTAATTAATAATGTTGCTAACAAA

SEQ ID NO:50.
Leishmania mexicana AAR06176:
ATGGAGCACGTGCAGCAGTACAAGTTCTACAAGGAGAAGAAGATGAGCAT
TGTGCTTGCCCCCTTCTCCGGCGGCCAACCGCACAGTGGGGTAGAGCTGG
GTCCTGACTACCTCCTCAAGCAGGGACTGCAGCAGGACATGGAGAAGCTT
GGATGGGATACAAGGCTCGAGAGGGTGTTCGACGGCAAGGTTGTTGAGGC
TCGCAAGGCGAGCGATAATGGCGACAGGATCGGTCGTGTCAAGCGCCCGA
GGCTGACAGCGGAGTGCACGGAGAAGATCTACAAGTGTGTGCGCAGGGTG
GCCGAGCAGGGTCGCTTTCCTCTCACCATCGGTGGCGATCACTCCATCGC
CCTCGGCACGGTGGCCGGTGTGTTGTCCGTGCACCCGGATGCCGGGGTGA
TTTGGGTGGACGCCCACGCGGACATCAACACTATGTCTGGCACGGTCTCC
GGCAACTTGCACGGCTGCCCCTTATCGATCCTGTTGGGGCTTGATCGCGA
GAACATTCCCGAGTGCTTTTCGTGGGTACCGCAGGTGCTGAAGCCGAACA
AGATTGCCTACATTGGTCTGCGTGCTGTGGACGACGAGGAGAAGAAGATC
CTGCACGACCTGAACATCGCCGCCTTCAGCATGCATCACGTGGACCGCTA
CGGCATAGACAAGGTGGTGTCCATGGCGATCGAAGCCGTCTCGCCGAAGG
GTACGGAGCCGGTGATGGTGTCATACGACGTGGACACGATCGACCCCCTC
TACGTCCCGGCGACGGGCACTCCCGTGCGTGGCGGCCTCTCTTTCCGCGA
GGCGTTGTTCTTGTGCGAGCGTATCGCCGAGTGCGGTCGTCTTGTCGCTC
TGGACGTGGTGGAGTGCAACCCGCTCCTGGCCGCTACGGAATCGCACGTG
AACGACACCATCTCCGTCGGCTGCGCCATCGCACGCTGCATGATGGGAGA
GACACTTCTTTACACTCCGCATACGAGCTCCAAGCTATAG SEQ ID NO:51.
Saccharomyces cerevisiae (baker's yeast) M10110
(AAA34469):
TGATTTTTACATACCGTATATCCAATTTACGGCCCTTCACATATAGCGG
GAAATGATGGTAAGCTACGCATACTGTCTGACAGGACCCTATTCTAGCAA
CCTTACATGAAACAAAAACAAACAACATCACATCATACGGATGAACTACG
GGTGCAATCCCTGACTCATCAATGTTTATCATAAACTTAGATATCAACAC
TGATAAACCCCACCTCTATTTTTACTGGTTCTTCACTTTTTCGATGCCGC
ACCGTCGCCCGCGATCCCCGCCCTTTGATTGCTCCTTCCATTAACAGTTT
TTTTCTATCCCTTACAAGAAGCCGAGACGCCGCGAAAATATCGGCTAGTG
CGAATAGTCTCTAGCTCTTGCCCTTCGCAAAGCACCGTGCTGCTAATGGC
AATCAACAGCGCATCGCCGCTCGCTGAATTTTTCACTTAGCGGTAGCCGC
CGAGGGGTCTAAAGAGTATATAAGCAGAGCTTGCGGCCCACTTTCTATCA
AGATCTAAGACTGTTTCTCTTCTCTTGGTCTGTATATGTTTTCTCAAAGT
TAGCAGAAACAACAACAACAACTATATCAATAACAATAACTACTATCAAG
ATGGAAACAGGACCTCATTACAACTACTACAAAAATCGCGAATTGTCCAT
CGTTCTGGCTCCATTCAGCGGCGGTCAGGGTAAGCTTGGTGTCGAGAAGG
GCCCTAAATACATGCTTAAGCATGGTCTGCAAACAAGCATAGAGGATTTG
GGCTGGTCTACGGAATTAGAGCCCTCAATGGACGAGGCCCAATTTGTGGG AAAGTTGAAAATGGAGAAGGACTCCACAACTGGGGGTTCCTCTGTTATGA
TAGACGGTGTCAAGGCTAAAAGAGCAGATTTGGTTGGTGAAGCCACCAAG
TTGGTGTACAACTCCGTGTCGAAAGTGGTCCAGGCGAACAGATTCCCCTT
GACCTTGGGTGGTGATCATTCAATAGCCATTGGTACTGTATCCGCGGTTT
TGGACAAATACCCCGATGCTGGTCTTTATGGATAGACGCCCACGCTGAT
ATAAACACCATAGAAAGCACCCCCTCTGGAAACTTGCACGGCTGTCCCGT
GTCATTCCTAATGGGTTTGAACAAGGATGTCCCACATTGTCCCGAGTCGC
TCAAATGGGTTCCAGGCAACTTGAGCCCAAAAAGATCGCGTATATTGGG
TTGAGAGATGTTGATGCCGGAGAAAGAAAATCTTGAAAGATCTGGGTAT
CGCCGCCTTTTCCATGTACCACGTTGACAAATACGGCATCAACGCTGTCA
TTGAAATGGCAATGAAAGCCGTGCACCCAGAAACAAACGGTGAAGGTCCC
ATTATGTGCTCCTATGACGTCGATGGTGTAGACCCATTATACATTCCTGC
TACAGGTACTCCAGTGAGAGGTGGGTTGACCTTGAGAGAAGGTCTTTTCT
TGGTGGAAAGATTGGCCGAATCCGGTAATTTAATTGCGCTAGACGTTGTT
GAATGTAACCCTGATCTGGCTATTCATGATATCCATGTTTCAAACACCAT
CTCTGCAGGTTGCGCCATTGCAAGGTGTGCATTGGGTGAAACCTTATTGT
AGTTTATATCATCATCCCTTTTATCAAAATAAGCATTCTCTTTTTATTTT
AGTTAAGCACATGCATACATAAATTTACGAACAAAAAAAGAAAATAAATT
AAAATAAAAGTAGTGTATCTTCGTTACTTTTCATTCTTTTTGGTTAACCC
ACGTCTAATTGCCAATACACTATCGACGATCACGGCATCTACACCTGCTT
CAATTTGTATACTGGCATTTTCGGGATCATTGTTGTCCACACCGTAAGTG
ACACATACCAGCCCATTAGACTTAACCACTTGCACCAACCGTGGGGCCTT
TAAAATGGGTGC SEQ ID NO:52.
Schizosaccharomyces pombe (fission yeast) 'X75559
(CAA53236):
GAATTCCGTAGCTTAGTTTCGATCTTTTCCGTTCCATGGTAAATATGACT
TGTTTCAAAAAATGGCTATGGAAAATATCCCCAGAGGGTTGGGTGTATAT
TATGATTTTACGTCCTATTTCTATTAATTTTCCATAGTGTGATTTTTTCC
TTTCTTGAATTACTTTATTTTTATTTAATTTATTTTCTTTGCTTTATTTC
ATTTCGTTTGATTTATTTTATTTATTTATTTATTTTTTTTTTTAATAATA
GTGAACCGAGCTATCGTTACGGAGTATAGAAATGTTGAGTCCGTGGAATT
AATATCCCGTTTTTAGGTTGATGAGTCTAATATGATTGCCCGCAAGATCT
GATAACGGCCGGTAGATAAAATACTCAAAGACTATTGAGTAAGCAAACGC
TCACTATTTATTAAAGCCGTCATCGGCATGAAAAACGGAATTCCATAAAT
TTCGCAACCTCCCATCTACTTCAAAGGGTCCTTTGCTATACACAACATCG
TTTCTACCTGACTGAATCAAAAATATACAATGTCTCCTCATAAAATAC
CCGAAGTACATAGACATATTATGTCTAGTAGATACATGGAGGGAAATGCC
GTCTCTATCATAAATATGCCATTTTCAGGCGGTCAACCCAAGGACGGTGC
TGAATTGGCTCCAGAAATGATTGAGGCGGCTGGATTGCCTGAAGACTTGG
AGCGTCTTGGTTATAGTGTCAACGTCGTTCAAAATCCCAATTTAAAGT
CGACCTTTAAAAGAAGGCCCTAATCAAGCCCTCATGAAAAACCCACTCTA

```
CGTTAGCAATGTTACTCGCCAAGTTCGTAATATTGTTCAACAGGAACTAG
AGAAGCAAAGGATCGCGGTCAACATTGGAGGAGATCATTCACTTGCCATT
GGCACTGTTGAAGGTGTACAAGCTGTCTACGATGATGCTTGTGTCTTGTG
GATTGATGCCCATGCTGATATTAATACCCCCGATTCATCCCCTTCAAGA
ATCTTCATGGCTGCCCATTGTCCTTTTCCTTGGGATATGCCGAACCTCTT
CCTGAAGAGTTTGCTTGGACAAGAAGAGTAATTGAAGAGCGTCGTCTTGC
GTTCATCGGTTTGCGCGATTTGGATCCTATGGAACGTGCTTTTCTTCGTG
AACGCAGCATCACTGCTTACACTATGCACGATGTTGATAAATATGGAATA
GCCAGAGTAGTAGAAATGGCATTGGAACACATCAATCCAGGAAGGAGACG
TCCCATTCATCTTTCTTTTGACGTCGATGCCTGTGATCCAATTGTCGCTC
CAGCTACTGGAACCCGTGTGCCAGGCGGTTTGACCTTTCGTGAAGCAATG
TACATTTGTGAAAGTGTTGCAGAAACTGGCTCTCTAGTTGCTGTTGATGT
TATGGAAGTTAACCCACTTTTAGGCAACAAAGAGGAAGCCAAGACAACTG
TGGATTTAGCTCGCTCTATTGTTCGAACTTGTCTTGGTCAAACGTTATTG
TAGAACCATGTATTTTATGCTATATCATGAATTAGAAGTATGTTACGCGT
CGGATTAGCTACTGTGCTTTTTCAACGTCCCAACACACAAGTATATTAAT
AAACTCAAAATCTCATAATTCAGACACTGTACCGACAAACTTGGGCAAAG
TTACTGTTTGGTTCTCAGATACTTGACTAGACTATTTAAGAAAGAATTTT
AGTTTTT

SEQ ID NO:53.
Plasmodium yoelii EAA16981:
CCGAAGCACATATAATTTACACATTCTTCAAAAGCATAAATATCATATAT
TTATNTTCTTCCTTAATGTCTCCAATTAAGCACAATATGCATGCATATAT
TCTTTTTTCCTTTTCATGCGCTATGCATTTTTTATAAGTTTTAAAAAAAA
TTCGAAGCATATCATAATGATTTAGTGTTATGTAAAATGATTTAGTATTA
TGCAGTAATGATTTAGTATTATGTAATAATAATTTGAAATATAAAATTTG
CTATATCAAATTAGTTATATCAAATTAGCTATGTCAAATTAGCTATGTCA
AATTAGCTATGTCAAATTAGCTATGTCAATTTAGCTATATAAAATTAGCT
ATATAAAATTAACCATAAAAATCAGCAAAAATTAATAAAAAAAGTTTTGG
AAAATTATAAAATGCGGAGCGACGAAACTAATAAAGCAAACAAACCAATC
GAATTATCTCCTCTAGAAAATAATGATGAACAAAATAATGATGAACAAAA
TAATGATGAACAAAATAATGATGAACAAAATAATGATGAACAAAATAGTG
ATGAAATTAACGAGTTTGAATTAGAAGTTGAAGAAGAAGTCATTAATTAC
CTATCTTCTCTAATATATAATAAAAATGTTAAGCATAAGATTGTGAAAAT
AAATAATTTAATAGACGACCAAATATATAATTATATAGAAACTTGTAATC
ATTTAGGTAATATTACTAATTTAAATAAAGATCCAAAAGAAGAAAATCAA
AATATAAAAACAAATCAAGGAACATTAGATACCTCTCATATATCCAACCC
AATAAATGAAGAAACTAGCAAATATACAATTCATTCCAAAAGTAGCGATA
ATTTTGATATCATAAAAACAAATACATTGCCATTATTCTTATCCTCAAAA
TTAGATCAACAAAAAGAAGATCAAATAAAATGCAATCAAAATGAAAAAAA
ATGCAAAAATTTTAAAAGTTGCACTATAATAAATGAGACAACAAATATTA CACTTTTATACAATAAAAATGATTCACAAACAAATGTGTTATATGTATGT
TATGATGAAGAAAATGATGAATGTGAAATATGTAATAGTTATAGACTGAA
GTATATGCCAAATATGAGCATGTTTAAAAATGATAGTAATAACGATAAGG
GTAACGCACCCCAAAAGTGCAATGAGCATTTACTAAATTCATTAAAAGAT
TACTTCTTTGTTTTAGGGTCAACATCAAGCTCAAGAAAATATATATTAAA
AAAAGTGAATTAAATTTTTTATCTGTCCAAATAAAAATTAATGAAAAAA
AAATAGGATGTAGAAAAAAACTTGACCCATTTACATTAACATCTAATATA
TCAGTAGCAAAGGGAATGAAACTATTACATGTTATTAATAATGATAATAA
ATTAAAACAACAAATTTTAGAATTAAGTAAAAACAAAAAGTTTTATTGT
TAGTAGGAGATGAAGTTATTTATTGTAATAACCAAATATACGAAAAACCA
AAAAACAAAAAGAAGCATATAATTTTATTAAATCTTATAATAATAATAA
ATGTTATAGTTATAGCTCTATTACATTAATCGATTTAGTGTCTAACAAAA
TTATGACTGGAATTGATGAGTCAGTTTTAAGCTTTACTAATATGAGTGAC
GACACTATAGAAAATATTTTAAACGACCAATCTATCTATTATTGCGCTGG
TGCATTAAAGATTGAAAATGTTATTATGAGTAAATATTTGCAAGAAATCA
AGGGAAATATCGACAGCATTTTTGGCTTGTCCCTGAATCTCCTATTTCAT
TTAATCAACTTGTTATGACTTTACCCCCTACCGCTCATTAGCCAACCTAC
CACTTAGCCAGCACATTATCTCATTTATTGCTATTTTTATTTTTCTCCAA
CTTTTTGTTTGACATCTATTCACTACACACATATGTGCATGCACCCACTC
AGCCGTTCCGACAAACTAAATTTGAATACACATATTCTATAACAGTGCAT
AATTCTTTATACTTTATTATCCATACTTTCATTATTATACATATATAATA
TAACCACTTTAAAGGTGCTTACATATTACATTTGAGTTCAGTAAAAAAAA
AAAAAAAAAAATAAAATAAAATAAAATAAATATATTTATACCAT
ATATGTGTATGAATAGGGTGAAAAATGATCATAAAGAAAAGAGTGATTT
AATTATGTGTATGTATGAGCACTTGGTTTGAATTGTAAAACAAATCCAAT
CTACAACTATTTTATTCGTTTCTATCTTTGTATGATATCTTATTTTCTTT
TATTATAATAAACTAATATAAGGACTAATTTATTCATTTTACTATTTTAT
TTTTTTCTAAAATTAATGGATCAATAGCTGGTACACTAGGAGATTTCGAT
CTTCCTTTTTCAAGAAGGTTTTGAAAAAAACTATGCAAAATTTATCGCT
TTTATCATTATTATTTTCATTATTTGTTGAATTATAATTATTATTTTCAT
TATTATCAAGATTATTATTTCGATTTCCTTTGTCTGTATTTCTCACTCCA
TTTGATAATGCACTATTATCAATATCAATAGAATTCATGTCTTTTTTAT
ATATTCATTTTCTATGTTATCATTAGAAGGGTTTGTAGATATACTAGATA
AAAAATCGTTATAATAAATTGCAGGAACTATATTTTGACTATGTTCAGCA
ACAATTGTTTTATTTGTCATTGGTTTAATAATAATAGAATCATATGGTTT
GTTAAAATTTCCAACAAAAGTATTTTAATTGATTTATTTATTAATTTTT
CATCATCATATCCTGATGGTATAAATATTTTTTCATAACAATCTAATATT
TCATTTTCTTTAAATGGGAAATCATATAATCTATGCATTATATATTTATA
TAAAGTTCTATATTAATTAATTCATTTTTATTTATTGTATTACAAATA
TGATTGCACCTTGATAACTTATAGCTAAATTTCTTAAATAAGATATGATT
```

```
ACATCTATATATCCTTGATAGGTTCTATTATTTAATATTTCATATCCATC
CGATTTACATATCACAAAAATTATTGGAAAAGATAAATTTATTTTTATTA
ATTTTTTTTGATTTTCTTCATTTTTTACATTGTCTATATTTTGTTCTAAA
CCCGAATATACATCAATTTCTCGATTCTCTTTTTTTTCACAATTTTTTCC
TTGTTTGTAATTATATATATATTTTTTCTAATTCATCTTTTTAACCCACTAA
CAATATCTATATCATAATTTGAATACAATTCCTCATAAATTTTATGCATA
ACATCAACCCAAGTATTTATTTCAGAAATTATATTATATGGTTTATATAA
ATCAGTACAAATTAATATAATAATTTTTTTATATTTTGAATTTTTTTAA
GATTTTTAATTAACAAACTAGTATAAAAAGGATGTTGTAAAATCCAAACA
TGACTATTACCTTGTGTATCATGTATTTTTTTATCATCTTCGAAATTTTT
TATATTTAAACATCCATAATCAAAAGGCAATACTCTTATTTCACTTCTAT
ATAATAAGTCTAAATATTCTCCATCATTTTCTAATGCTATTTTTTGCAAT
GCTTTTAATAATGAAGATTTTCCCACATCTTTATTTCCTAAAATTATTAT
ATGACTACTTTCAACTTGTTCATTTTTATCTATATTTAATTTTTTTAATA
TTTTTTTATATACACTACTCTGTTCATCTTTTATTCCTTCTTCGCCATTT
TTTTTTTCTGAATTTTCTGCATTTTCAAACTTGATTTCATTTTTCAAAA
AATATTTACCTTGCCATTGTTAAACCCTGAACTTTCCACTTCAATTGGTA
CTCCACTCTCTACTTCATTCCTCACCTCATTTCTCACCTCATTTCTCACT
TCATTTCCCACTTCATTTTCCACTTCATTTCTCACTTCATTTTCCACTTC
ATTTTCCACTTCATTTCTCACTTCATTTTCCACTTCATTTCCCACTTCAT
TTCTCACTTCATTTTCCACTTGGCTCTCTTGCATGGTCAGCTTTTACTA
ATAACCTGGCTACCATTTTTATTGTCTTTTTGTTTTTTTTATTTTTAAA
ATTATCATCATTCTTTAATTTTGAAGTAGCTAATATATTTGCACTACTTC
CCTTGACCATATTTATATTATTTTTTTATTAAACAAATTTTCTTTTTTA
TTTCCTGAATCTTTTGGGATTTCTCTTCCATTTCCTGAATCTTTTGGGAT
TTCTCTTCCATTTCCTGAATCTTTTGGAATTTCTCTTCCATTTCCAGAAT
CTTTTGGAATCTCCTTTACATTTCCCTTTTTTTTCCACAATGTAACAGTA
CTTCCTCTTTTCAAAAAGCTAGCTGAGTGGTTTGAATTGTTAGAAGTGTT
AGACATTTCTTTCTTCATTTTTAACACCGTTTATATATCCTAACCTATGC
ACTATATTGCGTTTGCGCATGTACTATCTTTTACATGTACTATCTTTTAC
ATGTATTACGTTTTACATGTATTACGTTTTACATATATTTGTAACTTGCC
CCTTTTTTACTTATTTTCAAATATGCAAGACCGACCAAATGAAAAATAAA
ATAAAAAAGAAAAAAAAAGAAAAAAAAGAAAAAAAAAAGGAAAAAAA
AAAAAAAGCCGTATCCGTTTTATAAATAAAATACTAAATATATTTCACTG
CATTTTGTTAATTGTTGTCTTAACAAAATGCTTGAATTAAATATAAAAAA
TAGATAGAAGAAAAAAAAAAAAAATTCGGTCAAATAATTTGAATGATGT
AGTAAACTGTTATAAAGGTGACTGTTTAAACCAAAAGCAAAACTTGGAAA
AATCAAACATGGAAAAAATAAAACATGGAAAAATAAAACGTGGAAAAATA
AGAATAACATTTATGTTAAATTTATCAACTATATATATATTTTTTTTTT
TTTTAAATTCAAATGTGCATAGTATTTTAAATTTTTTTTTTTTTTTT

TTTTTTTTTTATTTCCTTAAATTTGTTCAATATAAATACAAACAGTTTTG
TCTACAAATTGTTTTATAATATGTTCTTAAATAAGTTACAAAATAAAAAA
TTGTCTTTTTTTTAGAGAAATATATTATGCTGTTTTGCCATTATCACCT
TGTAAACGAATATTTATTTGATCATTTGTTTGATCATTTTCCTACCCATT
TTCCTATCAATTTGTTTGCGTTATAAAGGCAAGCAAAAAAGTTAATGCAT
ATAAAACTGCCGATAAAATTACATTCCCCATATTTTCATTTTCCAACAAA
TACAAAACAGTAACTATTGTATCATAGCCTTAAACCTCCCATTTGCCAAC
TTTAAAAATTGGGGAAAAAGCTGAAAAAAAAGCTGAAAAAAAGCTGAAA
AAATTGGGAAAAAAGCTGAACAAAATTGGGGAAAAAGCTGAAAAAACA
TTCGTGTGCTACATATTTCCTTCACTATTCATTTCCTAAACCCAATAAAA
TATGTGGTTTATAGGTAGTTCATATAATTGATACATTGCCAACAGTTCGA
TACATTTTTTTAAATATATTTTTATGAATGTGATAAAAATGGTAAAAAC
ATTATAATCGTTTTATATATACATAACAGGGTTTATACTCACCACCTACA
AAATACAGTGGCACATATTTTGTGAAAAAAAAAAAAAAAAAAATAAAT
AAACCCAAAACAAAAAAAAGAAAAAAAAAAACATATTTGACCCAATTAGT
GTTATTTCCCCAAATATATGGTTAATTAAGTTGCAAATTTTTTAATTTTG
TATAATTTCTTATAAATTTAATTTATTTATAATTCATTAATTTGTATATA
GTTATATATTATTTATTTGTTTCATTTTGAAATATAATTAAAAGTTTCTA
TCTATTTTATGTTTACCTCTATTTGATACTTTACACTCTTTTATATAATT
CAAATCAAATGCAATCTATTTTTTTATAACCTCATTTAAGCAACGATTTC
CAAAGTTTGATTTACTCACCCCCCCCCCTAACATTAAATAATTGAGAAACT
GACCAAATATATAATAAGATCGACCAAATTGTAAAAAAAAAAAAAAACA
AAAAAAAAACAAAAAAAAAAACAAAATGTACGAATGTATCCAAAACTACT
TAACAAACATATAGATGAACAAAATATTTATGTTAAAAAATGTGTTTCA
ATTATTGGGTCTCCATTAGCTGCTGGCCAATCTCTTGGAGGTGTAAATAA
AGCATGTGACAATTTGAGGCAACTCGGATTATATGATGTTATTAAAGCTA
TGGGTTGGAAATATAACGATATTGGAAATATTGGGGAAAGTATATCGATC
AATACTTTTCTAAATTCAGCAAATGCCGAAAAGGGAATCAAAAAGGAGGC
TGAAAAGGAGGCTGAAAAGGGAGCCAAAAAGGAGGCTGAAAAGGAGGCTG
AAAAGGGAGCCAAAATAAATGGCAATGAATCAAACTACTATAGCAATATA
AAAAACGCACAAGTGATTGGCAAATTTAGTGAACAATTATTTCAAATCAT
GAGTTCAGAAATAAAAAAAAAAATTTTATTTTAAATATTGGGGAGATC
ATGGAGTAGCTTTTTCAAGCATACTAGCCACACTACAAACATATAAAAAT
TTAAAGTGATATGGATAGATGCACATGGAGATATAAATATACCAGAAAC
ATCTCCTTCTGGAAATTATCATGGAATGTCATTAGCACATGTATTAGGAT
TGTTTAAAAAAAAAGTTCCACATTTTGAATGGTCAGAAAATTTGTTACAT
TTAAAACCAGAAAATGTAGCTATTATTGGAATAAGAGATATTGATAAATA
TGAAAAAATCATTTTAAAAAATTGTAATATAAATTATTATACTATGTTTG
ATATAGATAAAAAAGGTATATACAACATTATTTGTGAAGCTTTAAATAAA
ATTGATCCAGATCAAAATTCTCCTATACATATATCATTAGATATTGATAG
```

TGTCGATTCAATATATGCTCCTGGAACTGGAACAATAGCTAAAGGTGGTT

TAAATTATAGAGAAATAAATTTATTAATGAAATCGATATCAGATACAAAA

CGAGTTGTATCTATGGATATTGTTGAATATAACCCACTTTTGGATGAAAA

TGATAAAGCAGTTCATGGAGATTCGCTACCAATTGATCCCAATGCTACTA

AAACTGGAAAATTATGTCTTGAGCTTATTGCCAGAGTCCTAGGCAATGAT

ATCGTGTAACCGTGCCAGAGTTATAGCAATGATATCGTGTAACCGTGCCA

GAGTTATAGGCAATGATATCGTGTAAACGTATCCYTTCCCCCATTTTNNT

TNNNCNNCNCCCCCCAAAATTNGGGCACATGCACGNNTATGCATCGTTTG

GCTTAGTACATGCGCCACTGAACCAACAGCATTACTAAATTATTATTTTT

TAAAAACATCTCTGGAAAG

SEQ ID NO:54.
*Lycopersicon esculentum* (tomato) LeARG2 GenBank
AY656838:
MKSAGSMGINYMQRLLTSNVPKEVVKRGQDRVVEASLTLIRERAKLKGEL

VRGLGGAVASTSLLGIPLGHNSSFLQGPAFAPPLIREAIWCGSTNSTTEE

GKILDDQRVLTDVGDLPVQELRDTGIDDDRLMSTVSESVKLVMDENPLRP

LVLGGDHSISYPVVRAVSEKLGGPVDILHLDAHPDIYDAFEGNKYSHASS

FARIMEGGYARRLLQVGIRSINLEGEQGKRFGVEQYEMRTFSRDRQFLEN

LKLGEGVKGVYISVDVDCLDPAFAPGVSHFESGGLSFRDVLNILHNLQGD

IVGADVVEYNPQRDTADGMTAMVAAKLVRELAAKMSK

SEQ ID NO:55.
*Lycopersicon esculentum* (tomato) LeARG1 GenBank
AY656837:
MRSAGRMGIHYMQKLHASNVPKELVEKGQNRVIEASLTLIRERAKLKGEL

VRALGGAVASTSLLGVPLGHNSSFLQGPAFAPPRIREAMWCGSTNSTTEE

GKELDDPRILTDVGDVPVQELRDAGVDDDRLMSIISESVKLVMEENPLRP

LVLGGDHSISYPVVRAVSEKLGGPIDILHLDAHPDIYHAFEGNKYSHASS

FARIMEGGYARRLLQVGIRSINKEGREQGKRFGVEQYEMRTFSQDRQFLE

NLKLGEGVKGVYISVDVDCMDPAFAPGVSHIEPGGLSFRDVLNILHNLQA

DVVGADVVEFNPQRDTVDGMTAMVAAKLVRELTAKISK

SEQ ID NO:56.
*Lycopersicon esculentum* (tomato) GenBank BT013286:
MRSAGRMGIHYMQKLHASNVPKELVEKGQNRVIEASLTLIRERAKLKGEL

VRALGGAVASTSLLGVPLGHNSSFLQGPAFAPPRIREAMWCGSTNSTTEE

GKELDDPRILTDVGDVPVQELRDAGVDDDRLMSIISESVKLVMEENPLRP

LVLGGDHSISYPVVRAVSEKLGGPIDILHLDAHPDIYHAFEGNKYSHASS

FARIMEGGYARRLLQVGIRSINKEGREQGKRFGVEQYEMRTFSQDRQFLE

NLKLGEGVKGVYISVDVDCMDPAFAPGVSHIEPGGLSFRDVLNILHNLQA

DVVGADVVEFNPQRDTVDGMTAMVAAKLVRELTAKISK

SEQ ID NO:57.
*Lycopersicon esculentum* (tomato); translated from
TIGR unigene TC142949:
MKSAGSMGINYMQKLLTSNVPKEVVKRGQDRVVEASLTLIRERAKLKGEL

VRGLGGAVASTSLLGIPLGHNSSFLQGPAFAPPLIREAIWCGSTNSTTEE

GKILDDQRVLTDVGDLPVQELRDTGIDDDRLMSTVSESVKLVMDENPLRP

LVLGGDHSISYPVVRAVSEKLGGPVDILHLDAHPDIYDAFEGNKYSHASS

FARIMEGGYARRLLQVGIRSINLEGREQGKRFGVEQYEMRTFSRDRQFLE

NLKLGEGVKGVYISVDVDCLDPAFAPGVSHFESGGLSFRDVLNILHNLQG

DIVGADVVEYNPQRDTADGMTAMVAAKLVRELAAKMSK

SEQ ID NO:58.
*Solanum tuberosum* translated from TIGR unigene
TC94228 (Genbank EST BM403790):
MKNAGRMGIHYMQKLHASNVPKELVEKGQNRVIEASLTLIRERAKLKGEL

VRALGGAVASTSLLGVPLGHNSSFLQGPAFAPPRIREAMWCGSTNSTTEE

GKELDDPRILTDVGDVPVQELRDAGVDDDRLMSIISESVKLVMEENPLRP

LVLGGDHSISYPVVRAVSEKLGGPIDILHLDAHPDIYDAFEGNKYSHASS

FARIMEGGYARRLLQVGIRSINKEGREQGKRFGVEQYEMQTYSQDRQFLE

NLKLGEGVKGVYISVDVDCMDPAFAPGVSHIEPGGLSFRDVLNILHNLQA

DVVGADVVEFNPQRDTVDGMTAMVAAKLVRELTAKISK

SEQ ID NO:59.
Lotus corniculatus var. japonicus (Lotus
japonicus) translated from TIGR unigene TC8390:
MFPKGMSTIARRGIHYMQEIQAAKVSPASLEQGQKGVIEASLALIRENAK

LKGELVRAYGGAVATSSLLGVPLGHNSSFLQGPAFAPPHIREAIWCGSTN

STTEEGKDLRDPRVLASVGDLAVQEIRECGVDDHRLMNVVSDAVKLVMEE

DPLRPLVLDDGHSITYPIVRAISEKLGGPIDLLHFDAHPDLYHEFEGNFY

SHASSFARIMEGGYARRLLQVGIRSINYEGREQAKKFGVEQYEMRTYSKD

RPFLENLKLGEGVKGVYISIDVDCLDPGYAPGVSHHESGGLSFRDVMNVL

QNLQGDIVGGDVVEYNPQRDTADDMTAMVAAKFVRELAAKMSK

SEQ ID NO:60.
*Arabidopsis thaliana* arginase mRNA, Krumpelman,
GenBank ACCESSION U15019:
MSRIIGRKGINYIHRLNSASFTSVSASSIEKGQNRVIDASLTLIRERAKL

KGELVRLLGGAKASTSLLGVPLGHNSSFLQGPAFAPPRIREAIWCGSTNS

ATEEGKELKDPRVLTDVGDVPVQEIRDCGVDDDRLMNVISESVKLVMEEE

PLRPLVLGGDHSISYPVVRAVSEKLGGPVDILHLDAHPDIYDCFEGNKYS

HASSFARIMEGGYARRLLQVGIRSINQEGREQGKRFGVEQYEMRTFSKDR

PMLENLKLGEGVKGVYISIDVDCLDPAFAPGVSHIEPGGLSFRDVLNILH

NLQADVVGADVVEFNPQRDTVDGMTAMVAAKLVRELAAKISK

SEQ ID NO:61.
*Arabidopsis thaliana* 1 GenBank AAK96469:
MSRIIGRKGINYIHRLNSASFTSVSASSIEKGQNRVIDASLTLIRERAKL

KGELVRLLGGAKASTSLLGVPLGHNSSFLQGPAFAPPRIREAIWCGSTNS

ATEEGKELKDPRVLTDVGDVPVQEIRDCGVDDDRLMNVISESVKLVMEEE

PLRPLVLGGDHSISYPVVRAVSEKLGGPVDILHLDAHPDIYDCFEGNKYS

HASSFARIMEGGYARRLLQVGIRSINQEGREQGKRFGVEQYEMRTFSKDR

PMLENLKLGEGVKGVYISIDVDCLDPAFAPGVSHIEPGGLSFRDVLNILH

NLQADVVGADVVEFNPQRDTVDGMTAMVAAKLVRELAAKISK

SEQ ID NO:62.
*Arabidopsis thaliana* 2 putative arginase GenBank
AAM64858;
MWKIGQRGVPYFQRLIAAPFTTLRSLPTSLVETGQNRVIDASLTLIRERA

KLKGELVRLIGGAKATTALLGVPLGHNSSFLEGPALAPTHVREAIWCGST

NSTTEEGKELKDPRVLSDVGDIPVQEIREMGVDDDRLMNVVSESVKLVME

EEPLPLVIGGDHSISYPVVRAVSEKLGGPVDILHLDAHPDIYDRFEGNYY

SHASSFARIMEGGYARRLLQVGIRSINKEGREQGKRFGVEQYEMRTFSKD

RQMLENLKLGEGVKGVYISIDVDCLDPGFAHGVSHFEPGGLSFRDVLNIL

HNLQGDLVGADVVGYNPQRDTADDMTAMVAAKFVRELAALKMSK

SEQ ID NO:63.
Glycine max (soybean) arginase (pAG1); Goldraij,
GenBank ACCESSION AF035671:
MSFLRSFARNKDISKVGRRGIHCMQKLCAEKISPDSLEKAQNRVIDAALT

LVRENTGLRKNLCHSLGGAVATSTLLGVPLGHNSSFLEGPAFAPPFIREG

IWCGSANSTTEEGKDLKDLRIMVDVGDIPIQEMRDCGIGDERLMKVVSDS

VKLVMEEDPLRPLILGGDPSISYPVVRAISEKLGGPVDVLHFDAHPDLYD

EFEGNYYSHASSFARIMEGGYARRLLQVGIRSINKEGREQAKKFGVEQFE

MRHFSKDRPFLENLNLGEGAKGVYISIDVDCLDPGYAVGVSHYESGGLSF

RDVMNMLQNLKGDIVGGDVVEYNPQREPPDRMTAMVAAKFVRELAAKMSK

SEQ ID NO:64.
Glycine max (soybean) translated from TIGR unigene
TC219468 (Genbank EST CF807934):
MSIITRRGIRYMPRLDAAKVSAALLEKGQNRVIDASLTLIRERAKLKGEL

VRALGGAKATSTLLGVPLGHNSSFLQGPAFAPPRIREAIWCGSTNSTTEE

GKELQDARVLTDVGDVPIQEIRDCGVDDHRLMNVIGESVKLVMEEDPLCP

LVLGGDHSISFPVIRAVSEKLGGPVDVLHLDAHPD

SEQ ID NO:65.
Glycine max (soybean) translated from TIGR unigene
TC215865 (Genbank EST AF035671):
MSFLRSFARNKDISKVGRRGIHCMQKLCAEKISPDSLEKAQNRVIDAALT

LVRENTRLKKELVHSLGGAVATSTLLGVPLGHNSSFLEGPAFAPPFIREG

IWCGSANSTTEEGKDLKDLRIMVDVGDIPIQEMRDCGIGDERLMKVVSDS

VKLVMEEDPLRPLILGGDHSISYPVVRAISEKLGGPVDVLHPDAHPDLYD

EFEGNYYSHASSFARIMEGGYARRLLQVGIRSINKEGREQAKKFGVEQFE

MRHFSKDRPFLENLNLGEGAKGVYISIDVDCLDPGYAVGVSHYESGGLSF

RDVMNMLQNLKGDIVGGDVVEYNPQRDTPDRMTAMVAAKFVRELAAKMSK

SEQ ID NO:66.
Glycine max (soybean) translated from TIGR unigene
TC219468 (Genbank EST CF807934):
MSIITRRGIRYMPRLDAAKVSAALLEKGQNRVIDASLTLIRERAKLKGEL

VRALGGAKATSTLLGVPLGHNSSFLQGPAFAPPRIREAIWCGSTNSTTEE

GKELQDARVLTDVGDVPIQEIRDCGVDDHRLMNVIGESVKLVMEEDPLCP

LVLGGDHSISFPDIRAVSEKLGGPVDVLHLDAHPDNYDAFEGNIYSHASS

FARVMEGDYVRRLLQVGIRSITAEGRAQAKKFGVEQYEMRTFSRDRPFLE

NLKLGEGVKGVYISIDVDCLDPAFAPGVSHIEPGGLSFRDVLNILHNLQG

AVVAGDVVELNPQRDTDDGM

SEQ ID NO:67.
Brassica napus (rape) arginase gene, ACCESSION
AF233433:
MSRIIGRKGINYIHRLNSASFTSVSASSIEKGQNRVIDASLTLIRERAKL

KGELVRLLGGAKASTLLGVPLGHNSSFLQGPAFAPPRIREAIWCGSTNS

ATEEGKELKDPRVLTDVGDVPVQEIIDCGVDDDRLMNVISESVKLVMEEK

PLRPLVLGGDHSISYPVVRAVSEKLGGPVDILHLDAHPDIYDCFEGNKYS

HASSFARIMEGGYARRLLQVGIRSINQEGREQGKRFGVEQYEMRTFSKDR

PMLENLKLGEGVKGVYISIDVDCLDPAFAPGVSHIEPGGLSFRDVLNILH

NLQADVVGADVVEFNPQRDTVDGMTAMVAAKLVR

SEQ ID NO:68.
Pinus taeda et al. (Poplar) translated from TIGR
unigene TC4665:
MSIIGKRGIHYLQKLKTANIPPELLEKGQNRVIDASLTLIRERAKLKGEL

LRALGGVKASSTLLGVPLGHNSSFLQGPAFAPPRIREAIWCGSTNSSTEE

GKELNDPRVLTDVGDVPVQEIRDCGVDDDRLMNVISESVKLVMEEDPLRP

LVLGGDHSISFPVVRAVSEKLGGPVDILHLDAHPDIYHCFEGNKYSHASS

FARIMEGGYALGFCKWVSDQ

SEQ ID NO:69.
Picea glauca (white spruce) translated from TIGR
unigene TC2715 (Genbank CO477874):
LRATEQLGGPVIHLDAHPDIYHSFEGNKYSHASFARIMEGGHARRLLQVG

IRSITKEGREQGKRFGVEQYEMHSFSKDREFLENLKLGEGVKGVYISDVD

CLDPAFAPGVSHLEPGGLSFRDVMNIVQNLQGDIVAADVVEFNPQRDTVD

GMTAMVAAKLVRELTSKMSKLAD

SEQ ID NO:70.
Cabernet Sauvignon translated from TIGR unigene
TC47457 (Genbank EST CF210075):
MRNIARKGIHYWQKLNAANVPAELIENGQNRVIDASLTLIRERAKLKGEL

VRALGGALASSSLLGVPLGHNSSFLQGPAFAPPRIREAIWCGSTNATTEE

GKELNDPRVLTDVGDVPVQEIRDCGVDDDRLMKIISESVKLVMEEDPLRP

LVLGGDHSISFPVVRAVSEKIGGPVDILHLDAHPDIYHSFEGNKYSHASP

FARIMEGGYARRLLQVGLRSITSEGREQGKRFGVEQYEMRTFSRDRHILE

NLKLGEGVKGVYISLDVDCLDPAFAPGVSHIEPGGLSFRDVLNILHNLQA

DVVAADVVEFNPQRDTVDGMTAMVAAKLVRELTAKMSKMKN

SEQ ID NO:71.
Saccharum officinarum translated from unigene
TC51697:
MGGAAAGTKWIHHIQRLSAVKVSAEAVERGQSRVIDASLTLIRERAKLKA

ELLRALGGVKASASLLGVPLGHNSSFLQGPAFAPPRIREAIWCGSTNSST

EEGKELNDPRVLTDVGDVPIQEIRDCGVEDDRLMHVISESVKTVMEEEPL

RPLVLGGDHSISYPVVRAVSEKLGGPVDILHLDAHPDIYDCFEGNTYSHA

SSFARIMEGGYARRLLQVGLRSITKEGREQGKRFGVEQYEMRTFSK

SEQ ID NO:72.
Gossypium Cotton translated from TIGR unigene
TC32845 (Genbauk EST CO128957):
MSSSGVVRRGIHYLQKLKAANIPSDLIEKGQNRVIDASLTLIRERAKLKG

ELVRALGGALASTLLGVPLGHNSSFLQGPAFAPPRIREAIWCGSTNSAT

EEGKELNDPRVLTDVGDVPVQEIRDCGVDDDRLMSVISESVKLVMEEDPL

RPLVLGGDHSISFPVVRAVSEKLGGPVDILHLDAHPDIYDCFEGNKYSHA

SSFARIMEGGYARRLLQVGIRSITTEGREQGKRFGVEQYEMRTFSKDCHF

LENLKLGEGVKGVYISVDVDCLDPAFAPGVSHIEPGGLSFRDVLNILPNL

EGNLVAADVVEFNPQRDPVDGMTAMVAAKLVRELAAKMSK

SEQ ID NO:73.
Sorghum (Sorghum bicolor) translated from TIGR
unigene TC103916 (Genbank EST CD227766):
MGGAAAGTKWIHHIQRLSAAKVSTEAVERGQSRVIDASLTLIRERAKLKA

ELLRALGGVKASASLLGVPLGHNSSFLQGPAFAPPRIREAIWCGSTNSST

EEGKELNDPRVLTDVGDVPIQEIRDCGVEDDRLMHVISESVKTVMEEEPL

RPLVLGGDHSISYPVVRAVSEKLGGPVDILHLDAHPDIYDCFEGNTYSHA

SSFARIMEGGYARRLLQVGLRSITKEGREQGKRFGVEQYEMRTFSKDREK

LENLKLGEGVKGVYVSVDVDCLDPAFAPGVSHIEPGGLSFRDVLNILQNL

QGDVVAADVVEFNPQRDTVDGMTAMVAAKLVRELTAKISK

SEQ ID NO:74.
Zea mays translated from TIGR unigene TC270225
(Genbank; AY106166):
MGGAAAGTKWIHHIQRLSAAKVSAEAVERGQSRVIDASLTLIRERAKLKA

ELLRALGGVKASASLLGVPLGHNSSFLQGPAFAPPRIREAIWCGSTNSST

EEGKELNDPRVLTDVGDVPIHEIRDCGVEDDRLMHVISESVKTVMEEEPL

RPLVLGGDHSISYPVVRAVSEKLGGPVDILHLDAHPDIYDCFEGNTYSHA

SSFARIMEGGYARRLLQVGLRSITKEGREQGKRFGVEQYEMRTFSKDREK

LENLKLGEGVKGVYVSVDVDCLDPAFAPGVSHIEPGGLSFRNVLNILQNL

QGDVVAADVVEFNPQRDTVDGMTAMVAAKLVRELTAKISK

SEQ ID NO:75.
Hordeum vulgare TIGR unigene TC147457 (Genbank EST
CA022688):
MGGAAAAASGAARWIQRLSAARISTEALERGQSRVIDASLTLIRERAKLK

GELLRAMGGVKASATLLGVPLGHNSSFLQGPAFAPPRIREAIWCGSTNSS

TEEGKELNDPRVLTDVGDVPIQEIRDCGVEDDRLMHVISDSVKTVMDEDP

LRPLVLGGDHSISYPVVRAVSEKLGGPVDILHLDAHPDIYDCFEGNTYSH

ASSFARIMEGGYARRLLQVGLRSITKEGREQGKRFGVEQYEMRTFSRDRE

KLENLKLGEGVKGVYVSVDVDCLDPAFAPGVSHIEPGGLSFRDVLNILQN

LQGDVVAGDVVEFNPQRDTVDGMTAMVAAKLVRELSAKISK

SEQ ID NO:76.
Triticum aestivum translated from TIGR unigene
TC108421 (Genbank EST CD913000):
MGGAAAAAGAARWIQRLSAARISTEALERGQSRVIDASLTLIRERAKLKG

ELLRAMGGVKASATLLGVPLGHNSSFLQGPAFAPPRIREAIWCGSTNSST

EEGKELNDPRVLTDVGDVPIQEIRDCGVEDDRLMHVISESVKTVMDEDPL

RPLVLGGDHSISYPVVRAVSEKLGGPVDILHLDAHPDIYDCFEGNTYSHA

SSFARIMEGGYARRLLQVGLRSITKEGREQGKRFGVEQYEMRTFSRDREK

LENLKLGEGVKGVYVSVDVDCLDPAFAPGVSHIEPGGLSFRDVLNILQNL

QGDVVAGDVVEFNPQRDTVDGMTAMVAAKLVRELSAKISK

SEQ ID NO:77.
Oryza sativa (japonica cultivar-group) translated
from TIGR unigene TC275196 (Genbank EST CR288830):
MGGVAAGTRWIHHVRRLSAAKVSADALERGQSRVIDASLTLIRERAKLKA

ELLRALGGVKASACLLGVPLGHNSSFLQGPAFAPPRIREAIWCGSTNSST

EEGKELNDPRVLTDVGDVPIQEIRDCGVEDDRLMNVVSESVKTVMEEDPL

RPLVLGGDHSISYPVVRAVSEKLGGPVDILHLDAHPDIYDAFEGNIYSHA

SSFARIMEGGYARRLLQVGIRSITKEGREQGKRFGVEQYEMRTFSKDREK

LESLKLGEGVKGVYISVDVDCLDPAFAPGVSHIEPGGLSFRDVLNILHNL

QGDVVAGDVVEFNPQRDTVDGMTAMVAAKLVRLELTAKISK

SEQ ID NO:78.
Oryza sativa (japonica cultivar-group) CAE02758:
MGGVAAGTRWIHHVRRLSAAKVSADALERGQSRVIDASLTLIRERAKLKA

ELLRALGGVKASACLLGVPLGHNSSFLQGPAFAPPRIREAIWCGSTNSST

EEGKELNDPRVLTDVGDVPIQEIRDCGVEDDRLMNVVSESVKTVMEEDPL

RPLVLGGDHSISYPVVRAVSEKLGGPVDILHLDAHPDIYDAFEGNIYSHA

SSFARIMEGGYARRLLQVGIRSITKEGREQGKRFGVEQYEMRTFSKDREK

LESLKLGEGVKGVYISVDVDCLDPAFAPGVSHIEPGGLSFRDVLNILHNL

QGDVVAGDVVEFNPQRDTVDGMTAMVAAKLVRELTAKISKMGGVAAGTRW

IHHVRRLSAAKVSADALERGQSRVIDASLTLIRERAKLKAELLRALGGVK

ASACLLGVPLGNHSSFLQGPAFAPPRIREAIWCGSTNSSTEEGKELNDPR

VLTDVGDVPIQEIRDCGVEDDRLMNVVSESVKTVMEEDPLRPLVLGGDHS

ISYPVVRAVSEKLGGPVDILHLDAHPDIYDAFEGNIYSHASSFARIMEGG

YARRLLQVGIRSITKEGREQGKRFGVEQYEMRTFSKDREKLESLKLGEGV

KGVYISVDVDCLDPAFAPGVSHIEPGGLSFRDVLNILHNLQGDVVAGDVV

EFNPQRDTVDGMTAMVAAKLVRELTAKISK

SEQ ID NO:79.
Populus (Poplar) translated from TIGR unigene
TC4665 (Genbank EST AJ777022):
MSIIGKRGIHYLQKLKTANIPPELLEKGQNRVIDASLTLIRERAKLKGEL

LRALGGVKASSTLLGVPLGHNSSFLQGPAFAPPRIREAIWCGSTNSSTEE

GKELNTDPRVLTDVGDVPVQEIRDCGVDDDRLMNVISESVKLVMEEDPLR

PLVLGGDHSISFPVVRAVSEKLGGPVDILHLDAHPDIYHCFEGNKYSHAS

SFARIMEGGYALGFCKWVSDQ

SEQ ID NO:80.
Allium cepa (onion) TIGR unigene TC890 (Genbank
ACABQ32):
MSTHAIKWIQSLKRMSTGNLPAEIIEKGQNRVIEASLTLIRERAKLKGEL

LRALGGAKASATLLGVPLGHNSSFLQGPAFAPPRIREAIWCGSTNSATEE

GKDLKDSRILTDVGDVPIQEIRDCGVDDDRLMNIISESVKLVMEEHPLRP

LVLGGDHSISYPVVRAVAEKLGGPVDILHLDAHPDIYDAFEGNKYSHASS

FAKIMEGGHARRPFTSWNKGQLLMKDGNKG

SEQ ID NO:81.
Capsicum annuum (pepper) translated from TIGR uni-
gene TC2786:
GGYARRLCQVGIRSINKEGREQGKRFGVEQYEMRTFSRDREYLENLKLGE

GVKGVYISVDLDCMDPAFAPGVSHIEPGGLSFRDVLNILHNLQADVVGAD

VVEFNPQRDTVDGMTAMVAAKLVRELTAKISKWPAVIPNL

SEQ ID NO:82.
Theobroma cacao (cacao) TIGR unigene TC466
(Genbank CF973050):
MSAIGPEQRNSLFAETECCKYPSDLIEKGQSRVIDASLTLIREKAKLGE

LVRALGGSLASTSLLGVPLGHNSSFLQGPAFALPRIREAMWCGSTNSSTE

EGKELKDPRVLTDVGDLAVQEIRDCGVDDDRLMNVVSESVKIVMEEDPLR

PLVLGGATQYLIL

SEQ ID NO:83.
*Medicago truncatula* translated from TIGR unigene
TC87301 (Genbank EST BI271401):
MSTIARRGIHYMQRLNSANVSSALLENGQNRVIDASLTLIRERAKLKGEL

VRALGGAVATSSLLGVPLGHNSSFLQGPAFAPPRIREAIWCGSTNSTTEE

GKDLQDARVLTDVGDVPIQEIRDCGVDDHRLMNVIGESVKLVMEEDPLRP

LVLGGDHSISFPVIRAVSEKLGGPVDVLHLDAHPDNYDEFEGNYYSHASS

FARVMEGNYVRRLLQVGIRSITTEGRAQAKKFGVEQYEMRTFSRDRHFLE

NLKLGEGVKGVYISIDVDCLDPAFAPGVSHIEPGGLSFRDVLNILHNLQG

DVVAGDVVEFNPQRDTVDGMTAMVAAKLVRELAAKIAK

SEQ ID NO:84.
*Arabidopsis thaliana* 1 (thale cress) AAK96469:
MSRIIGRKGINYIHRLNSASFTSVSASSIEKGQNRVIDASLTLIRERAKL

KGELVRLLGGAKASTSLLGVPLGHNSSFLQGPAFAPPRIREAIWCGSTNS

ATEEGKELKDPRVLTDVGDVPVQEIRDCGVDDDRLMNVISESVKLVMEEE

PLRPLVLGGDHSISYPVVRAVSEKLGGPVDILHLDAHPDIYDCFEGNKYS

HASSFARIMEGGYARRLLQVGIRSINQEGREQGKRFGVEQYEMRTFSKDR

PMLENLKLGEGVKGVYISIDVDCLDPAFAPGVSHIEPGGLSFRDVLNILH

NLQADVVGADVVEFNPQRDTVDGMTAMVAAKLVRELAAKISK

SEQ ID NO:85.
*Arabidopsis thaliana* 2 (thale cress) AAM64858:
MWKIGQRGVPYFQRLIAAPFTTLRSLPTSLVETGQNRVIDASLTLIRERA

KLKGELVRLIGGAKATTALLGVPLGHNSSFLEGPALAPTHVREAIWCGST

NSTTEEGKELKDPRVLSDVGDIPVQEIREMGVDDDRLMNVVSESVKLVME

EEPLRPLVIGGDHSISYPVVRAVSEKLGGPVDILHLDAHPDIYDRFEGNY

YSHASSFARIMEGGYARRLLQVGIRSINKEGREQGKRFGVEQYEMRTFSK

DRQMLENLKLGEGVKGVYISIDVDCLDPGFAHGVSHFEPGGLSFRDVLNI

LHNLQGDLVGADVVGYNPQRDTADDMTAMVAAKFVRELAAKMSK

SEQ ID NO:86.
*Drosophila melanogaster* (fruit fly):
MWWSRKFASRSLRLHRLKSTGSTAPREPEQSLGIIGVPFAKGQAKQGVEL

APDLLRQSSLRQVLQSSHDGLVIRDYGNLQYAVDEPLLQQQRVHYHHIRN

YADFMACNRALIEQVKLMLVENTQFLAIGGDHAIGFGSVAGHLQHTPNLS

LVWIDAHADINLHSTSQSGNIHGMPVSFLLEQLRNTWQHAGLQEIAPNCL

PKDQLVYIGLRDIDPYEAFILNKVGIRYYAMDTIDRVGVPKIIEMTLDAL

NPQNKIHVSFDIDALDSNVAPSTGTAVRGGLTLREGISIVEALRDTKRVQ

GVDLVEINPKLGSERDVRTTVESGLEILKSMFGYRRSGRWSNIDTGILGS

D

SEQ ID NO:87.
*Danio rerio* (zebra fish) AAH56711:
MAMRGPLSRLLKSTLTSCQQNRSHSVAILGAPFSKGQKRRGVEHGPKAIR

DAGLVERLSNLDYPVHDFGDLTFKHLEKDEHFMHVPFPRTVGRANQLLSG

AVSGAVGAGHTCIMLGGDHSLAIGSVEGHSQQCPDLCLIWVDAHADINTP

LTSPSGNLHGQSVAFLLKDLQNKMPVPGFSWMKPFLSARDLVYIGLRDV

DPGEHVFLKTLGIQYFSMRDIDRMGIQRVMEVTLDHLLARKQRPIHLSFD

IDAFDPSLAPATGTPVNGGLTYREGIYITEEIHNTGLLSVMDVVEVNPTL

GAAPEAVEATTSLAVDIVASALGQTREGAHVSFPKITEPKEDTELRL

SEQ ID NO:88.
*Xenopus laevis* (African clawed frog) Arg1-prov
BC043635:
MSSQGKTSVGVIGAPFSKGQPRRGVEEGPKYLREAGLIEKLREFGNDVRD

CGDLDFPDVPNDTPFNNVKNPRTVGKATEILANAVTAVKKADKTCLTIGG

DHSLAVGTIAGHAAVHPNLCVVWVDAHADINTPSTSPSGNLHGQPLSFLM

KELKSKMPAVPGFEWVKPCLRSKDIVYIGLRDVDPGEHYILKTLGIKYYS

MSEVDYLKIDKVMEETLEYLVGKHKRPIHLSFDIDGLDPSIAPATGTPVP

GGLTYREGMYITEQLHKTGLLSAVDIMEVNPSRGETKRDVEVTVKTALDM

TLSCFGKAREGFHASTMMLPDIF

SEQ ID NO:89.
Gallus gallus putative agmatinase AAK97629:
MICLLRTARLSARLLFASAAAPCRRASRFNVPPSAEFVARPVGVCSMLRL

PVQTSAEGLDAAFVGVPLDTGTSNRPGARFGPQQIRAESVMVRRYNASTG

AAPFDSLLVADVGDVNVNLYNLPDSCRRIRESYQKIVASGCVPLTLGGDH

SITYPILQAVAEKHGPVGLVHVDAHTDTSDMALGEKIYHGTPFRRCVDEG

LLDCSRVVQIGIRGSSYAPNPYKYCWDQGFRVVPAEECWMKSLVPLMGEV

RQQMGDGPVYISFDIDGLDPAYAPGTGTPEIAGLTPMQALEIIRGCKGLN

IVGCDLVEVAPIYDVSGNTALLGANLLFEMLCVLPGVKTM

SEQ ID NO:90.
*Rattus norvegicus* (Norway rat) type I arginase
NP_058830:
MSSKPKPIEIIGAPFSKGQPRGGVEKGPAALRKAGLVEKLKETEYNVRDH

GDLAFVDVPNDSPFQIVKNPRSVGKANEQLAAVVAETQKNGTISVVLGGD

HSMAIGSISGHARVHPDLCVIWVDAHTDINTPLTTSSGNLHGQPVAFLLK

ELKGKFPDVPGFSWVTPCISAKDIVYIGLRDVDPGEHYIIKTLGIKYFSM

TEVDKLGIGKVMEETFSYLLGRKKRPIHLSFDVDGLDPVFTPATGTPVVG

GLSYREGLYITEEIYKTGLLSGLDIMEVNPTLGKTPEEVTRTVNTAVPLT

LSCFGTKREGNHKPETDYLKPPK

SEQ ID NO:91.
*Rattus norvegicus* (Norway rat) arginase type II
NP_062041:
MFLRSSVSRLLHGQIPCALTRSVHSVAVVGAPFSRGQKKKGVEYGPAAIR

EAGLLKRLSMGCHIKDFGDLSFTNVPKDDPYNNLVVYPRSVGIANQELAE

VVSRAVGGYSCVTLGGDHSLAIGTISGHARHHPDLCVIWVDAHADINTP

LTTVSGNIHGQPLSFLIRELQDKVPQLPGFSWIKPCLSPPNLVYIGLRDV

EPAEHFILKSFDIQYFSMRDIDRLGIQKVMEQTFDRLIGKRKRPIHLSFD

IDAFDPKLAPATGTPVVGGLTYREGLYITEEIHSTGLLSALDLVEVNPHL

ATSEEEAKATASLAVDIASSFGQTREGGHIAYDHLPTPSSPHESEKEEC

VRI

SEQ ID NO:92.
*Mus musculus* (house mouse) arginase1, liver,
AAH50005:
MSSKPKSLEIIGAPFSKGQPRGGVEKGPAALRKAGLLEKLKETEYDVRDH

GDLAFVDVPNDSSFQIVKNPRSVGKANEELAGVVAEVQKNGRVSVVLGGD

HSLAVGSISGHARVHPDLCVIWVDAHTDINTPLTTSSGNLHGQPVSFLLK

ELKGKFPDVPGFSWVTPCISAKDIVYIGLRDVDPGEHYIIKTLGIKYFSM

TEVDKLGIGKVMEETFSYLLGRKKRPIHLSFDVDGLDPAFTPATGTPVLG

GLSYREGLYITEEIYKTGLLSGLDIMEVNPTLGKTAEEVKSTVNTAVALT

LACFGTQREGNHKPGTDYLKPPK

SEQ ID NO:93.
*Mus musculus* 2 (house mouse) Arginase type II
AAH23349:
MFLRSSASRLLHGQIPCVLTRSVHSVAIVGAPFSRGQKKLGVEYGPAAIR

EAGLLKRLSRGCHLKDFGDLSFTNVPQDNPYNNLVVYPRSVGLANQELAE

VVSRAVSGGYSCVTMGGDHSLAIGTIIGHARHRPDLCVIWVDAHADINTP

LTTVSGNIHGQPLSFLIKELQDKVPQLPGFSWIKPCLSPPNIVYIGLRDV

EPPEHFILKNYDIQYFSMREIDRLGIQKVMEQTFDRLIGKRQRPIHLSFD

IDAFDPKLAPATGTPVVGGLTYREGVYITEEIHNTGLLSALDLVEVNPHL

ATSEEEAKATARLAVDVIASSFGQTREGGHIVYDHLPTPSSPHESENEEC

VRI

SEQ ID NO:94.
*Sus scrofa* (pig) AAK91874:
MSFKSQSIGIIGAPFSKGQPRGGVEEGPTALRKAGLLEKLKEQECDVKDY

GDLCFADVPNDTPFQIVKNPRSVGKANQQLADVVAEIKKNGRTSLVLGGD

HSMAIGSISGHARVHPDLCVIWVDAHTDINTPLTTTTGNLHGQPVSFLLK

ELKEKIPEVPGLSWVTPCLSAKDIVYIGLRDVDPAEHYILKTLGIKYFSM

IEVDKLGIGKVMEEAFSYLLGRKKRPIHLSFDVDGLDPFFTPATGTPVHG

GLSYREGIYITEEIYKTGLLSGLDIMEVNPSLGKTPEEVTRTVNTAVALV

LACFGVAREGNHKPIDYLKPPK

SEQ ID NO:95.
*Homo sapiens* 1 (human) arginase (EC3.5.3.1)
AAA51776:
MSAKSRTIGIIGAPFSKGQPRGGVEEGPTVLRKAGLLEKLKEQECDVKDY

GDLPFADIPNDSPFQIVKNPRSVGKASEQLAGKVAQVKKNGRISLVLGGD

HSLAIGSISGHARVHPDLGVIWVDAHTDINTPLTTTSGNLHGQPVSFLLK

ELKGKIPDVPGFSWVTPCISAKDIVYIGLRDVDPGEHYILKTLGIKYFSM

TEVDRLGIGKVMEETSYLLGRKKRPIHLSFDVDGLDPSFTPATGTPVVG

GLTYREGLYITEEIYKTGLLSGLDIMEVNPSLGKTPEEVTRTVNTAVAIT

LACFGLAREGNHKPIDYLNPPK

SEQ ID NO:96.
*Homo sapiens* 2 nonhepatic arginase BAA13158:
MSLRGSLSRLLQTRVHSILKKSVHSVAVIGAPFSQGQKRKGVEHGPAAIR

EAGLMKRLSSGCHLKDFGDLSFTPVPKDDLYNNLIVNPRSVGLANQELAE

VVSRAVSDGYSCVTLGGDHSLAIGTISGHARHCPDLCVVWVDAHADINTP

LTTSSGNLHGQPVSFLLRELQDKVPQLPGFSWIKPCISSASIVYIGLRDV

DPPEHFILKNYDIQYFSMRDIDRLGIQKVMERTFDLLIGKRQRPIHLSFD

IDAFDPTLAPATGTPVVGGLTYREGMYIAEEIHNTGLLSALDLVEVNPQL

ATSEEEAKTTANLAVDVIASSFGQTREGGHIVYDQLPTPSSPDESENQAR

VRI

SEQ ID NO:97.
*Bradyrhizobium japonicum* NP_772762:
MTDRTMPDRARRIALLGAPIDMGASQRGTLMGPPALRTAGLATLLESLDF

EVVDYGDLSVAEVRDLADRPPEKANHYREIQRWTRVLSRRGYEIAKTGAL

PIFLGGDHTLSMGSVNAMARHWQERGRELFVLWLDAHADYNTPETTITAN

MHGMSAAFLCGEPGLDGLLGDDPRASIDPDRLDLFGARSIDKLEKELMRA

RRIRVVDMRQIDEFGVAVLIRRVIERVKASNGVLHVSFDVDFLDPCVAPG

VGTTVPGGATYREAHLIMELLHDSGVVGSVDIVELNPFLDERGRTARTAV

ELIGSLFGQQITDRPTPSNAIAPGE

SEQ ID NO:98.
*Agrobacteriumtume faciens* 1 NP_356634:
MFILPCLHGLVQRSVGKARTGMDIRLVGAPLQIGAGQLGCEMGPSAYRVA

GLAHALEELGHRVVDTGNVMPAPLREFCHPNPAVHHLAETVAWTEALTEA

AYRESADAVPIFLGGDHAISAGTVAGMARRVAETGRPFFVLWLDAHTDYH

TLETTRSGNLHGTPVAYFSGRDGFSGYFPPLSHAVAEENIGMIGIRSVDP

AERAALEKSGITVHDMRSIDEHGVAVILREFLARVQAANGLLHVSLDVDF

LEPSIAPAVGTTVPGGATFREAHLVMEMLHDSGLVCSLDLVELNPFLDER

GRTATLMVDLATSLMGKRVMDRPTRAG

SEQ ID NO:99.
*Agrobacteriumtume faciens* 2 CAA33894:
NGAGEINASRHRKENELKTCQILGAPVQSGASQPGCLMGPDAFRTAGLTQ

VLTELGWAVTDLGDATPTVEPELSHPNSAVKNLDALVGWTRSLSQKALEM

ARSCDLPVFLGGDHSMSAGTVSGVAQRTAELGKEQFVLWLDAHTDLHTLH

TTASGNLHGTPVAYYTGQSGFEGLPPLAAPVNPRNVSMMGIRSVDPEERR

RVAEIGVQVADMRVLDEQGVVRPLEAFLDRVSKVSGRLHVSLDVDFLDPA

IAPAVGTTVPGGATFREAHLIMEMLHDSGLVTSLDLAELNPFLDERGRTA

RLITDLASSLFGRRVFDRVTTAF

SEQ ID NO:100.
*Brucella melitensis* biovar Abortus (*Brucella abortus*) AAC05588:
MHCKILGLPVQEGTGRKGCNMGPDSYRAAGIADAIRELGHECTDLGNLAP

AAQRPLQHPNHAIKALPYAVAWIEAISEAAYRESAEGFPIFLGGDHLLAA

GTVPGIARRAAEKGRKQFVLWLDAHTDFHTLETTTSGNLHGTPVAYYTGQ

KGFEGYFPKLAAPIDPHNVCMLGIRSVDPAEREAVKKTEVIVYDMRLIDE

HGVAALLRRFLERVKAEDGLLHVSLDVDFLDPSIAPAVGTTVPGGATFRE

AHLIMEMLHDSGLVTSLDLVELNPFLDERGRTAAVMVDLMASLLGRSVMD

RPTISY

SEQ ID NO:101.
*Plasmodium yoelii* EAA16981:
MYECIQNYLTKHIDEQNIYVKKCVSIIGSPLAAGQSLGGVNKACDNLRQL

GLYDVIKAMGWKYNDIGNIGESISINTFLNSANAEKGIKKEAEKEAEKGA

KKEAEKEAEKGAKINGNESNYYSNIKNAQVIGKFSEQLFQIMSSEIKKKN

FILNIGGDHGVAFSSILATLQTYKNLKVIWIDAHDGINIPETSPSGNYHG

MSLAHVLGLFKKKVPHFEWSENLLHLKLPENVAIIGIRDIDKYEKIILKN

CNINYYTMFDIDKKGIYNIICEALNKIDPDQNSPIHISLDIDSVDSIYAP

GTGTIAKGGLNYREINLLMKSISDTKRVVSMDIVEYNPLLDENDKAVHGD

-continued

SLPIDPNATKTGKLCLELIARVLGNDIV

SEQ ID NO:102.
*Schistosoma japonicum* AAQ16108:
MLKSVATPYYPVQNGETPKLLYPHVNFLGIPVNKGQPKLGTYQGPDFIRK

SNFFQLVAEDGIQITDCGDVIPVELSESEDPERCGMKWSRSFTQTTLKIA

DRVEQLVKGSNKHSIESSNSKPSPLVIVGGDHSMATGTILGHARAKPDVC

IIWVDAHGDINTPPNSTTGNIHGMPLSFLVKELQDQIPWLDDFHSIKPCL

DASNLVYIGLRDLDVYETRDIRKHAIAYFTMLDVDRMGMEAVIKEALQAV

NPRLEKPIHLSFDIDALDPSIAPSTGTAVPGGLTLREGLRICEEISATGK

LSIVELAELNPLLGSKEDVEKTQSSAVHILRASLGHCRSGQLPMKVNNST

TNTIVRQAERIQIK

SEQ ID NO:103.
*Leishmania mexicana* AAR06176:
MEHVQQYKFYKEKKMSIVLAPFSGGQPHSGVELGPDYLLKQGLQQDMEKL

GWDTRLERVEDGKVVEARKASDNGDRIGRVKRPRLTAECTEKIYKCVRRV

AEQGRFPLTIGGDHSIALGTVAGVLSVHPDAGVIWVDAHADINTMSGTVS

GNLHGCPLSILLGLDRENIPECFSWVPQVLKPNKIAYIGLRAVDDEEKKI

LHDLNIAAFSMHHVDRYGIDKVVSMAIEAVSPKGTEPVMVSYDVDTIDPL

YVPATGTPVRGGLSFREALFLCERIAECGRLVALDVVECNPLLAATESHV

NDTISVGCAIARCMMGETLLYTPHTSSKL

SEQ ID NO:104.
*Saccharomyces cerevisiae* (baker's yeast) AAA34469:
METGPHYNYYKNRELSIVLAPFSGGQGKLGVEKGPKYMLKHGLQTSIEDL

GWSTELEPSMDEAQFVGKLKMEKDSTTGGSSVMIDGVKAKRADLVGEATK

LVYNSVSKVVQANRFPLTLGGDHSIAIGTVSAVLDKYPDAGLLWIDAHAD

INTIESTPSGNLHGCPVSFLMGLNKDVPHCPESLKWVPGNLSPKKIAYIG

LRDVDAGEKKILKDLGIAAFSMYHVDKYGINAVIEMAMKAVHPETNGEGP

IMCSYDVDGVDPLYIPATGTPVRGGLTLREGLFLVERLAESGNLIALDVV

ECNPDLAIHDIHVSNTISAGCAIARCALGETLL

SEQ ID NO:105.
*Schizosaccharomyces pombe* (fission yeast)
CAA53236:
MSPHKIPEVHRHIMSSRYMEGNAVSIINMPFSGGQPKDGAELAPEMIEAA

GLPEDLERLGYSVNVVQNPKFKSRPLKEGPNQALMKNPLYVSNVTRQVRN

IVQQELEKQRIAVNIGGDHSLAIGTVEGVQAVYDDACVLWIDAHADINTP

DSSPSKNLHGCPLSFSLGYAEPLPEEFAWTRRVIEERRLAFIGLRDLDPM

ERAFLRERSITAYTMHDVDKYGIARVVEMALEHINPGRRRPIHLSFDVDA

CDPIVAPATGTRVPGGLTFREAMYICESVAETGSLVAVDVMEVNPLLGNK

EEAKTTVDLARSIVRTCLGQTLL

SEQ ID NO:106.
*Neurospora crassa* P33280:
MSPSLVDNHAAAYIAAPSSAKAPMIQKPGNTFGMSSPIESKFLSQPRDLG

IVAVGFSGGQCKLPGVDAAPSALIESGLLTQLREELGYRLHGDDEVHLYT

DLVPKEDPPHRNMKNPRAVSNVTKRIAEQVHSHAKEGRLVLTLGGDHSIA

IGTIAGSAKAIKERLGREIAVIWVDAHADINTPETSGSGNIHGMPVSFLT

GLASEDKEEFFGWLKPDHLLSVKKLVYIGLRDVDPGEKRILRENGIKAFS

-continued

MHDIDKHGIGRVMEMALGHIGNDTPIHLSFDVDALDPMWAPSTGTPVRGG

LTLREGDFICECVHETGSLVAVDLVEVNPTLAAPNDVGAHETVRAGCSLV

RCALGESLL

SEQ ID NO:107.
*Bacillus subtilis* CAA57400:
MDKTISVIGMPMDLGQARRGVDMGPSAIRYAHLIERLSDMGYTVEDLGDI

PINREKIKNDEELKNLNSVLAGNEKLAQKVNKVIEEKKFPLVLGGDHSIA

IGTLAGTAKHYDNLGVIWYDAHGDLNTLETSPSGNIHGMPLAVSLGIGHE

SLVNLEGYAPKIKPENVVIIGARSLDEGERKYIKESGMKVYTMHEIDRLG

MTKVIEETLDYLSACDGVHLSLDLDGLDPNDAPGVGTPVVGGISYRESHL

AMEMLYDAGIITSAEFVEVNPILDHKNKTGKTAVELVESLLGKKLL

SEQ ID NO:108.
*Bacillus caldovelox* S68863:
MKPISIIGVPMDLGQTRRGVDMGPSAMRYAGVIERLERLHYDIEDLGDIP

IGKAERLHEQGDSRLRNLKAVAEANEKLAAAVDQVVQRGRFPLVLGGDHS

IAIGTLAGVAKHYERLGVIWYDAHGDVNTAETSPSGNIHGMPLAASLGFG

HPALTQIGGYSPKIKPEHVVLIGVRSLDEGEKKFIREKGIKIYTMHEVDR

LGMTRVMEETIAYLKERTDGVHLSLDLDGLDPSDAPGVGTPVIGGLTYRE

SHLAMEMLAEAQIITSAEFVEVNPILDERNKTASVAVALMGSLFGEKLM

SEQ ID NO:109.
*Bacillus halodurans* NP_244816:
MNKFQKVSIIGVPMDLGQKRRGVDMGPSAMRYAGLIEEIEALGFEVKDYG

DIPINRPATSETQEGPLRNLDEVVKVSEELCKGVAAIEAEHSFPLILGGD

HSISIGSIAGIRKSYNNLGVIWYDAHPDLNTEETSPSGNIHGMPLAVNLG

IGHERLMNIGGITPKVKPEHIVIIGARSIDEGERQLIREQGIKVYTMHEV

DRMGMTRVIEETIDYLSARTDGVHLSFDLDGIDPVDAPGVGTPVLGGISY

RESHLALEMLAESELITSAEFVEINPILDNKNQTANVAVALVTSLLGKKL

L

SEQ ID NO:110.
*Bacillus brevis* JC5866:
PMDLGADRRGVDMGPSAIRYAGVVARLEKMGFNIEDRGDIFVTLPHHFTE

TENHKYLDEVVEANEKLANVVSDIMTAGRFPLVLGGDHSIALGTIAGVAK

HVKNLGVICLDAHGDLNTGATSPSGNIHGMPLAASLGYGHERLTNIGGYT

PKVKAENVVIIGARDLDQGERELIKRIGMKVFTMHEIDKLGMARVMDEAI

AHVSKNTDGVHLSLDLDGLDPHDAPGVGTPVIGGISYREGHVSLEMLADA

DILCSAEFVEVNPILDRENMTARVAVALMSSVFGDKLL

SEQ ID NO:111.
*Brucella melitensis* biovar Abortus (*Brucella abortus*) AAC05588:
MHCKILGLPVQEGTGRKGCNMGPDSYRAAGIADAIRELGHECTDLGNLAP

AAQRPLQHPNHAIKALPYAVAWIEAISEAAYRESAEGFPIFLGGDHLLAA

GTVPGIARRAAEKGRKQFVLWLDAHTDFHTLETTTSGNLHGTPVAYYTGQ

KGFEGYFPKLAAPIDPHNVCMLGIRSVDPAEREAVKKTEVIVYDMRLIDE

HGVAALLRRFLERVKAEDGLLHVSLDVDFLDPSIAPAVGTTVPGGATFRE

AHLIMEMLHDSGLVTSLDLVELNPFLDERGRTAAVMVDLMASLLGRSVMD

RPTISY

SEQ ID NO:112.
Agrobacterium tumefaciens 1 NP_356634:
MFILPCLHGLVQRSVGKARTGMDIRLVGAPLQIGAGQLGCEMGPSAYRVA

GLAHALEELGHRVVDTGNVMPAPLREFCHPNPAVHHLAETVAWTEALTEA

AYRESADAVPIFLGGDHAISAGTVAGMARRVAETGRPFFVLWLDAHTDYH

TLETTRSGNLHGTPVAYFSGRDGFSGYFPPLSHAVAEENIGMIGIRSVDP

AERAALEKSGITVHDMRSIDEHGVAVILREFLARVQAANGLLHVSLDVDF

LEPSIAPAVGTTVPGGATFREAHLVMEMLHDSGLVCSLDLVELNPFLDER

GRTATLMVDLATSLMGKRVMDRPTRAG

SEQ ID NO:113.
Agrobacterium tumefaciens 2 CAA33894:
MNGAGEINASRHRKENELKTCQILGAPVQSGASQPGCLMGPDAFRTAGLT

QVLTELGWAVTDLGDATPTVEPELSHPNSAVKNLDALVGWTRSLSQKALE

MARSCDLPVFLGGDHSMSAGTVSGVAQRTAELGKEQFVLWLDAHTDLHTL

HTTASGNLHGTPVAYYTGQSGFEGLPPLAAPVNPRNVSMMGIRSVDPEER

RRVAEIGVQVADMRVLDEQGVVRPLEAFLDRVSKVSGRLHVSLDVDFLDP

AIAPAVGTTVPGGATFREAHLIMEMLHDSGLVTSLDLAELNPFLDERGRT

ARLITDLASSLFGRRVFDRVTTAF

SEQ ID NO:114.
LeARG1 forward primer:
5'-GGA ATT CCA TAT GAG GAG TGC TGG AAG AAT-3

SEQ ID NO:115.
LeARG1 reverse primer:
5'-CCG CTC GAG CTT GGA TAT CTT GGC AGT AAG-3'

SEQ ID NO:116.
LeARG2 forward primer:
5'-GGA ATT CCA TAT GAA GAG TGC TGG AAG TAT-3'

SEQ ID NO:117.
LeARG2 reverse primer:
5'-CCG CTC GAG CTT GGA CAT CTT GGC AGC AAG-3'

SEQ ID NO:118.
C terminus:
LEHHHHHH

SEQ ID NO:119.
LeARG1-specific probe:
5'-CCC CTT CAC AAG AGA AGA AAT-3'

SEQ ID NO:120.
LeARG1-specific probe:
5'-TTC TGA TTA TCC TAC AAC TGC-3'

SEQ ID NO:121.
Gene specific probe for LeARG1 233-bp product
hybridizes to the 5' UTR of LeARG1 transcripts:
5'-CCCCTTCACAAGAGAAATGGATTGGCTTAATCAGTCGGTGATTACGT

GTAAATTGTGCTAATCTCCGTTGCCTAATAACAATATTTCCATTTTCATA

CTCCACCCGCTGCAAGCACCAAATCCCATTATATTACTACTAAAAACGAC

TGCATGTCTTCTTCTTTTTTAAACTCAGCGATTGCCTTCTTTTTTTGCTC

TCATCACTCTTTCTTGCAGTTGTAGGATAATCAGAA-3' (233 bp)

SEQ ID NO:122.
primer used for PCR amplification of the sequence
from EST clone cLEM17F16.
5'-CCCCTTCACAAGAGAAAT-3'

SEQ ID NO:123.
primer used for PCR amplification of the sequence
from EST clone cLEM17F16
5'-GCAGTTGTAGGATAATCAGAA-3'

SEQ ID NO:124.
LeARG2-specific probe:
5'-CAA GCA AGA AGT ACC ATG TAT-3'

SEQ ID NO:125.
T7 primer:
5'-TAA TAC GAC TCA CTA TAG GG-3' (T7 primer)

SEQ ID NO:126.
T3 primer:
5'-ATTAACCCTCACTAAAGGGA-3'

SEQ ID NO:127.
a 349-bp product that included 48 bp from the
pBluesript 5K vector Gene specific probe for
LeARG2
5'-CAAGCAAGAAGTACCATGTATCCTATTAGTGTACTCATCTTTATGCG

AAAATAAGTGTTTATTCACATTAGGTAGGTCTGGCAGATGCTCAGTTTCC

TATGGCAAGGGGGATTGGGATTATCTGTAAACTTGCCTCCCAAAATAAGC

TAGTATATTTGCAGTTCCTTATGAGTAACCTGTTGTTGTAAGTGACACTT

GTATCATTTGGTATGGAGTTTGTTGTGTATGGATGTTTTGAATCTTAAAA

AAAAAAAAAAAAAAAAAAAAAAAAAAAAAAAAAAAAAAAAAAAAAAAAAA

AAAACTCGAGGGGGGGCCCGGTACCCAATTCGCCCTATAGTGAGTCGTAT

TA-3' (349 bp)

SEQ ID NO:128.
primer used for amplification of the sequence from
EST clone cTOA4L10.
5'-CAAGCAAGAAGTACCATGTAT-3'

SEQ ID NO:129.
primer used for amplification of the sequence from
EST clone cTOA4L10.
5'-CCCTATAGTGAGTCGTATTA-3'.

SEQ ID NO:130.
EST clone cLED1D24 (GenBank accession number:
AI484542)
5'-TCAAATCTTTCAGATCTTTCTTTGACAAACTTCAAATCACCATCAAT

CATGGCAGCAGAAGGTTCTCAGTTTGATGCTCGTCAATTCGATGCAAAAA

TGACAGAACTGCTTGGTACTGAACAACAGGAATTCTTCACATCATATGAT

GAGGTTCACGACAGTTTTGATGCCATGGGTTTGCAAGAAAATCTCCTGAG

GGGCATCTATGCCTATGGTTTTGAGAAGCCATCTGCTATTCAGCAAGGG

GCATTGTTCCTTTTTGCAAGGGCCTTGATGTCATCCAGCAGGCACAATCT

GGTACTGGAAAGACGGCAACTTTCTGCTCTGGAATTCTCCAGCAGCTTGA

TTACAGTTTAGTTGAGTGTCAGGCTCTGGTTCTTGCACCAACCCGTGAGC

TTGCACAACAGATTGAGAAAG-3'

SEQ ID NO:131.
The 1.0-kb PCR product for LeARG1 that was subse-
quently cut with NdeI and XhoI subcloned into the
same sites of expression vector pET-23b
5'-GGAATTCCATATGAGGAGTGCTGGAAGAATGGGAATCCATTATATGC

AGAAATTGCACGCGTCAAATGTTCCAAAAGAATTGGTGGAAAAAGGACAG

AATCGTGTTATAGAGGCATCTCTTACACTTATTCGTGAAAGAGCAAAACT

TAAGGGAGAGCTTGTTCGTGCTCTTGGAGGTGCTGTAGCCTCAACGTCTC

TTCTTGGAGTTCCTCTGGGACATAACTCTTCATTTCTCCAGGGGCCAGCA

TTTGCTCCTCCTCGTATACGAGAGGCTATGTGGTGTGGCAGTACAAACTC

-continued

TACAACTGAGGAAGGAAAAGAATTAGATGATCCACGCATCTTAACTGATG

TTGGTGATGTGCCTGTGCAAGAGTTACGAGATGCAGGTGTAGATGATGAT

AGGTTAATGAGTATCATAAGCGAATCTGTCAAGCTAGTTATGGAAGAGAA

TCCATTGCGCCCCTTGGTGTTAGGGGGTGATCACTCTATATCCTATCCTG

TTGTAAGAGCTGTGTCTGAAAAGCTTGGAGGGCCTATTGATATCCTTCAC

CTTGATGCTCATCCTGACATTTATCATGCCTTTGAAGGAAACAAATACTC

ACATGCATCAAGCTTTGCACGGATAATGGAGGGTGGTTATGCTCGACGGC

TTTTGCAAGTGGGAATTAGATCAATTAATAAAGAAGGTCGAGAACAAGGA

AAAAGGTTCGGTGTGGAGCAATATGAAATGCGAACATTTTCCCAAGACCG

ACAATTTTTGGAGAATCTGAAACTTGGCGAAGGTGTGAAGGGCGTGTATA

TCTCAGTGGATGTTGACTGTATGGATCCAGCATTTGCTCCTGGAGTATCT

CATATAGAACCAGGAGGTCTCTCTTTCCGCGATGTTCTAAACATACTGCA

TAACCTTCAAGCTGATGTTGTTGGTGCTGATGTGGTTGAGTTCAACCCGC

AGCGTGATACTGTTGATGGCATGACTGCAATGGTTGCTGCGAAGCTGGTA

AGAGAACTTACTGCCAAGATATCCAAGCTCGAGCGG-3' (1033 bp)

SEQ ID NO:132.
primer used for amplification of the sequence from EST clone cLEM17F16.
5'-GGAATTCCATATGAGGAGTGCTGGAAGAAT SEQ ID NO:133.
primer used for amplification of the sequence from EST clone cLEM17F16.
5'-CTTACTGCCAAGATATCCAAGCTCGAGCGG-3'

SEQ ID NO:134.
The 1.0-kb PCR product for LeARG2 that was subsequently cut with NdeI and XhoI subcloned into the same sites of expression vector pET-23b
5'-GGAATTCCATATGAAGAGTGCTGGAAGTATGGGAATCAACTATATGC

AGAAATTGCTAACGTCAAATGTTCCAAAAGAAGTAGTCAAAAGAGGACAG

GATCGTGTTGTAGAGGCATCTCTTACACTTATTCGTGAAAGAGCAAAACT

TAAGGGAGAGCTTGTTCGTGGACTTGGAGGTGCAGTAGCGTCAACGTCAC

TTCTTGGAATTCCTCTGGGACACAACTCTTCATTTCTCCAGGGCCCTGCA

TTTGCTCCTCCTCTTATACGAGAGGCTATTTGGTGTGGCAGTACAAACTC

CACAACTGAGGAAGGAAAAATATTAGATGATCAACGTGTCTTAACTGATG

TTGGTGATCTGCCAGTACAAGAGTTACGAGACACAGGCATAGATGACGAT

AGGTTGATGAGTACAGTAAGTGAATCTGTCAAGCTAGTTATGGACGAGAA

TCCATTGCGCCCCTTGGTGTTAGGGGGTGATCACTCTATATCCTATCCTG

TTGTAAGAGCTGTGTCTGAAAAGCTTGGAGGACCTGTTGATATCCTTCAC

CTTGATGCTCATCCTGACATTTATGATGCATTTGAAGGAAACAAATACTC

ACATGCATCAAGCTTTGCACGAATAATGGAGGGTGGTTATGCTCGACGCC

TTTTGCAAGTTGGAATTAGATCAATTAATCTAGAAGGTCGAGAACAAGGA

AAAAGGTTTGGTGTGGAGCAATATGAAATGCGAACATTTTCGAGAGCAG

ACAATTTTTGGAGAATCTGAAACTTGGTGAAGGTGTAAAGGGCGTGTATA

TATCCGTGGATGTTGACTGTTTGGATCCAGCATTTGCTCCTGGAGTATCT

CATTTTGAGTCAGGCGGTCTCTCGTTCCGCGATGTTCTAAACATACTGCA

TAACCTTCAAGGTGATATCGTTGGTGCTGATGTCGTTGAGTACAACCCAC

AGCGTGATACTGCTGATGGCATGACTGCAATGGTTGCTGCGAAGCTGGTA

AGAGAACTTGCTGCCAAGATGTCCAAGCTCGAGCGG-3' (1033 bp)

SEQ ID NO:135.
primer used for amplification of the sequence from EST clone cTOA4L10.
5'-GGAATTCCATATGAAGAGTGCTGGAAGTAT SEQ ID NO:136.
primer used for amplification of the sequence from EST clone cTOA4L10.
5'-CTTGCTGCCAAGATGTCCAAGCTCGAGCGG-3'

SEQ ID NO:137.
LeARG1 full length cDNA sequence
5'-GCACGAGGGTCCCCTTCACAAGAGAAATGGATTGGCTTAATCAGTCG

GTGATTACGTGTAAATTGTGCTAATCTCCGTTGCCTAATAACAATATTTC

CATTTTCATACTCCACCCGCTGCAAGCACCAAATCCCATTATATTACTAC

TAAAAACGACTGCATGTCTTCTTCTTTTTTAAACTCAGCGATTGCCTTCT

TTTTTTGCTCTCATCACTCTTTCTTGCAGTTGTAGGATAATCAGAATAAA

CAAATATGAGGAGTGCTGGAAGAATGGGAATCCATTATATGCAGAAATTG

CACGCGTCAAATGTTCCAAAAGAATTGGTGGAAAAAGGACAGAATCGTGT

TATAGAGGCATCTCTTACACTTATTCGTGAAAGAGCAAAACTTAAGGGAG

AGCTTGTTCGTGCTCTTGGAGGTGCTGTAGCCTCAACGTCTCTTCTTGGA

GTTCCTCTGGGACATAACTCTTCATTTCTCCAGGGGCCAGCATTTGCTCC

TCCTCGTATACGAGAGGCTATGTGGTGTGGCAGTACAAACTCTACAACTG

AGGAAGGAAAAGAATTAGATGATCCACGCATCTTAACTGATGTTGGTGAT

GTGCCTGTGCAAGAGTTACGAGATGCAGGTGTAGATGATGATAGGTTAAT

GAGTATCATAAGCGAATCTGTCAAGCTAGTTATGGAAGAGAATCCATTGC

GCCCCTTGGTGTTAGGGGGTGATCACTCTATATCCTATCCTGTTGTAAGA

GCTGTGTCTGAAAAGCTTGGAGGGCCTATTGATATCCTTCACCTTGATGC

TCATCCTGACATTTATCATGCCTTTGAAGGAAACAAATACTCACATGCAT

CAAGCTTTGCACGGATAATGGAGGGTGGTTATGCTCGACGGCTTTTGCAA

GTGGGAATTAGATCAATTAATAAAGAAGGTCGAGAACAAGGAAAAAGGTT

CGGTGTGGAGCAATATGAAATGCGAACATTTTCCCAAGACCGACAATTTT

TGGAGAATCTGAAACTTGGCGAAGGTGTGAAGGGCGTGTATATCTCAGTG

GATGTTGACTGTATGGATCCAGCATTTGCTCCTGGAGTATCTCATATAGA

ACCAGGAGGTCTCTCTTTCCGCGATGTTCTAAACATACTGCATAACCTTC

AAGCTGATGTTGTTGGTGCTGATGTGGTTGAGTTCAACCCGCAGCGTGAT

ACTGTTGATGGCATGACTGCAATGGTTGCTGCGAAGCTGGTAAGAGAACT

TACTGCCAAGATATCCAAGTGACCTGCAGTAATTTCTAAAATTATGAAGG

AAGAATTACCATGCATCCAATAGAGACCACTAGATTTGTACTCATCTTTA

CTGGGGAGGTTTAACAGAGAATAAGCACCAAAATGAAGTGTTTATTCACC

TTATTGTAACTCTAAAACTAAAAGCTATATTTGCAGTTCATTATGAGGAC

CCTGTGATTCTTATAATCTTTTAAGTGGTGCAAAAAAAAAAAAAAAAA

AAAAAAAAAA-3' (1508)

SEQ ID NO:138.
5' UTR of LeARG1 transcripts
GCACGAGGGTCCCCTTCACAAGAGAAATGGATTGGCTTAATCAGTCGGTG

ATTACGTGTAAATTGTGCTAATCTCCGTTGCCTAATAACAATATTTCCAT

TTTCATACTCCACCCGCTGCAAGCACCAAATCCCATTATATTACTACTAA

AAACGACTGCATGTCTTCTTCTTTTTTAAACTCAGCGATTGCCTTCTTTT

TTTGCTCTCATCACTCTTTCTTGCAGTTGTAGGATAATCAGAATAAACAA

AT

SEQ ID NO:139.
3' UTR of LeARG2 transcripts
CCTGCAGTAATTTCTAAAATTATGAAGGAAGAATTACCATGCATCCAATA

GAGACCACTAGATTTGTACTCATCTTTACTGGGGAGGTTTAACAGAGAAT

AAGCACCAAAATGAAGTGTTTATTCACCTTATTGTAACTCTAAAACTAAA

AGCTATATTTGCAGTTCATTATGAGGACCCTGTGATTCTTATAATCTTTT

AAGTGGTGCAAAAAAAAAAAAAAAAAAAAAAAAAAAAA

SEQ ID NO:140.
LeARG2 full length cDNA sequence
5'-GTTCTTGTAGTAAACAAATATGAAGAGTGCTGGAAGTATGGGAATCA

ACTATATGCAGAAATTGCTAACGTCAAATGTTCCAAAAGAAGTAGTCAAA

AGAGGACAGGATCGTGTTGTAGAGGCATCTCTTACACTTATTCGTGAAAG

AGCAAAACTTAAGGGAGAGCTTGTTCGTGGACTTGGAGGTGCAGTAGCGT

CAACGTCACTTCTTGGAATTCCTCTGGGACACAACTCTTCATTTCTCCAG

GGCCCTGCATTTGCTCCTCCTCTTATACGAGAGGCTATTTGGTGTGGCAG

TACAAACTCCACAACTGAGGAAGGAAAAATATTAGATGATCAACGTGTCT

TAACTGATGTTGGTGATCTGCCAGTACAAGAGTTACGAGACACAGGCATA

GATGACGATAGGTTGATGAGTACAGTAAGTGAATCTGTCAAGCTAGTTAT

GGACGAGAATCCATTGCGCCCCTTGGTGTTAGGGGGTGATCACTCTATAT

CCTATCCTGTTGTAAGAGCTGTGTCTGAAAAGCTTGGAGGACCTGTTGAT

ATCCTTCACCTTGATGCTCATCCTGACATTTATGATGCATTTGAAGGAAA

CAAATACTCACATGCATCAAGCTTTGCACGAATAATGGAGGGTGGTTATG

CTCGACGCCTTTTGCAAGTTGGAATTAGATCAATTAATCTAGAAGGTCGA

GAACAAGGAAAAAGGTTTGGTGTGGAGCAATATGAAATGCGAACATTTTC

CAGAGACAGACAATTTTTGGAGAATCTGAAACTTGGTGAAGGTGTAAAGG

GCGTGTATATATCCGTGGATGTTGACTGTTTGGATCCAGCATTTGCTCCT

GGAGTATCTCATTTTGAGTCAGGCGGTCTCTCGTTCCGCGATGTTCTAAA

CATACTGCATAACCTTCAAGGTGATATCGTTGGTGCTGATGTCGTTGAGT

ACAACCCACAGCGTGATACTGCTGATGGCATGACTGCAATGGTTGCTGCG

AAGCTGGTAAGAGAACTTGCTGCCAAGATGTCCAAGTGACCTGCAGTAAT

TTTCAATTTTAACAAGCAAGAAGTACCATGTATCCTATTAGTGTACTCAT

CTTTATGCGAAAATAAGTGTTTATTCACATTAGGTAGGTCTGGCAGATGC

TCAGTTTCCTATGCAAGGGGGATTGGGATTATCTGTAAACTTGCCTCCC

AAAATAAGCTAGTATATTTGCAGTTCCTTATGAGTAACCTGTTGTTGTAA

GTGACACTTGTATCATTTGGTATGGAGTTTGTTGTGTATGGATGTTTTGA

ATCTTAAAAAAAAAAAAAAAAAAAAAAAAAAAAAAAAAAAAAAAAAA

AAAAAAAAAAAAA-3' (1360 bp)

SEQ ID NO:141.
5' UTR of LeARG2 transcripts
5'GTTCTTGTAGTAAACAAAT-3'

SEQ ID NO:142.
3' UTR of LeARG2 transcripts
5'CCTGCAGTAATTTTCAATTTTAACAAGCAAGAAGTACCATGTATCCTA

TTAGTGTACTCATCTTTATGCGAAAATAAGTGTTTATTCACATTAGGTAG

GTCTGGCAGATGCTCAGTTTCCTATGGCAAGGGGGATTGGGATTATCTGT

AAACTTGCCTCCCAAAATAAGCTAGTATATTTGCAGTTCCTTATGAGTAA

CCTGTTGTTGTAAGTGACACTTGTATCATTTGGTATGGAGTTTGTTGTGT

ATGGATGTTTTGAATCTTAAAAAAAAAAAAAAAAAAAAAAAAAAAAAAAA

AAAAAAAAAAAAAAAAAAAAAAAA-3'

SEQ ID NO:143.
Sequence with SmaI and SacI sites amplified from
EST clone cTOC4L10 to construct LeARG2 gene over-
expression vector
5'-TCCCCCGGGGGAGGTTCTTGTAGTAAACAAATATGAAGAGTGCTGGA

AGTATGGGAATCAACTATATGCAGAAATTGCTAACGTCAAATGTTCCAAA

AGAAGTAGTCAAAAGAGGACAGGATCGTGTTGTAGAGGCATCTCTTACAC

TTATTCGTGAAAGAGCAAAACTTAAGGGAGAGCTTGTTCGTGGACTTGGA

GGTGCAGTAGCGTCAACGTCACTTCTTGGAATTCCTCTGGGACACAACTC

TTCATTTCTCCAGGGCCCTGCATTTGCTCCTCCTCTTATACGAGAGGCTA

TTTGGTGTGGCAGTACAAACTCCACAACTGAGGAAGGAAAAATATTAGAT

GATCAACGTGTCTTAACTGATGTTGGTGATCTGCCAGTACAAGAGTTACG

AGACACAGGCATAGATGACGATAGGTTGATGAGTACAGTAAGTGAATCTG

TCAAGCTAGTTATGGACGAGAATCCATTGCGCCCCTTGGTGTTAGGGGGT

GATCACTCTATATCCTATCCTGTTGTAAGAGCTGTGTCTGAAAAGCTTGG

AGGACCTGTTGATATCCTTCACCTTGATGCTCATCCTGACATTTATGATG

CATTTGAAGGAAACAAATACTCACATGCATCAAGCTTTGCACGAATAATG

GAGGGTGGTTATGCTCGACGCCTTTTGCAAGTTGGAATTAGATCAATTAA

TCTAGAAGGTCGAGAACAAGGAAAAAGGTTTGGTGTGGAGCAATATGAAA

TGCGAACATTTTCCAGAGACAGACAATTTTTGGAGAATCTGAAACTTGGT

GAAGGTGTAAAGGGCGTGTATATATCCGTGGATGTTGACTGTTTGGATCC

AGCATTTGCTCCTGGAGTATCTCATTTTGAGTCAGGCGGTCTCTCGTTCC

GCGATGTTCTAAACATACTGCATAACCTTCAAGGTGATATCGTTGGTGCT

GATGTCGTTGAGTACAACCCACAGCGTGATACTGCTGATGGCATGACTGC

AATGGTTGCTGCGAAGCTGGTAAGAGAACTTGCTGCCAAGATGTCCAAGT

GACCTGCAGTAATTTTCAATTTTAACAAGCAAGAAGTACCATGTATCCTA

TTAGTGTACTCATCTTTATGCGAAAATAAGTGTTTATTCACATTAGGTAG

GTCTGGCAGATGCTCAGTTTCCTATGGCAAGGGGGATTGGGATTATCTGT

AAACTTGCCTCCCCGAGCTCG-3' (1218 bp)

SEQ ID NO:144.
primer used for amplification of the sequence from
EST clone cTOA4L10
5'-TCCCCCGGGGGAGGTTCTTGTAGTAAACAA SEQ ID NO:145.
5'-at SEQ ID NO:146.
5'-CCTGCAGTAATTTTCAATTTTAACAAGCAAGAAGTACCATGTATCCT
ATTAGTGTACTCATCTTTATGCGAAAATAAGTGTTTATTCACATTAGGTA
GGTCTGGCAGATGCTCAGTTTCCTATGGCAAGGGGGATTGGG SEQ ID NO:147.
primer used for amplification of the sequence from
EST clone cTOA4L10
5'-ATTATCTGTAAACTTGCCTCCCCGAGCTCG-3'

SEQ ID NO:148.
Rattus norvegicus (rat liver arginase) arginase 1
(Arg1), by NOHA (Boucher) Mrna ACCESSION
NM_017134):
CTCAGCTGCAGGAACCCTGGATGAGCATGAGCTCCAAGCCAAAGCCCATA
GAGATTATCGGAGCGCCTTTCTCTAAGGGACAGCCTCGAGGAGGGGTAGA
GAAAGGTCCCGCAGCATTAAGGAAAGCTGGCCTGGTGGAGAAGCTTAAAG
AAACAGAGTACAATGTGAGAGACCACGGGGATCTGGCCTTTGTGGATGTC
CCCAATGACAGCCCCTTTCAAATTGTGAAGAACCCACGGTCTGTGGGAAA
AGCCAATGAACAGCTGGCTGCTGTGGTAGCAGAGACCCAGAAGAATGGAA
CAATCAGTGTGGTGCTGGGTGGAGACCACAGTATGGCAATTGGAAGCATC
TCTGGCCACGCCAGGGTCCACCCTGACCTATGCGTCATTTGGGTGGATGC
TCACACTGACATCAACACTCCGCTGACAACCAGCTCTGGGAATCTGCACG
GGCAACCGGTGGCCTTTCTCCTGAAGGAACTGAAAGGAAAGTTCCCAGAT
GTACCAGGATTCTCCTGGGTGACCCCCTGCATATCTGCCAAGGACATCGT
GTACATCGGCTTGCGAGATGTGGACCCTGGGGAACACTATATAATAAAAA
CTCTGGGCATTAAGTATTTCTCAATGACTGAAGTGGACAGCTGGGAATT
GGCAAAGTGATGGAAGAGACCTTCAGCTACCTGCTGGGAAGGAAGAAAG
GCCCATTCACCTGAGTTTTGATGTTGATGGACTGGACCCAGTATTCACCC
CGGCTACGGGCACACCCGTTGTGGGAGGCCTATCTTACAGAGAAGGTCTC
TACATCACAGAAGAAATTTACAAGACAGGGCTACTTTCAGGACTAGATAT
CATGGAAGTGAACCCAACTCTTGGGAAGACACCAGAGGAGGTGACTCGTA
CTGTGAACACGGCAGTGCCGTTGACCTTGTCTTGTTTTGGAACGAAACGG
GAAGGTAATCATAAGCCAGAGACTGACTACCTTAAACCACCGAAATAAAT
GTGAATACATCGCATAAAAGTCATCTGGGCATCACAGCAAACCGAACAG
AACCAGGCCAACGCTGCTCCTCCCAAGGGCTTGTTCTTTTAGAAAAAGA
ATGTTTTTTCCCAATATGTATGTATTCTAGCAGTTCCTTTCTGGAATGAA
ATTCAGGGTGTGGGAATTAAAACAGCTATGAAATTAGGAGACACGTACTT
CCCATTTTAGCAGAAGTTATCCTTAAGAAGTAGTATAAATTAATATCTAA
TTAAAAAATGCACCAGGAGTTAAAATACACAGTGATGTCAAGTGTCAACT
CACGGTTGGAAGCAAAGGCATCTGGAGACGAGGCCTGCATCCACGTCGTT
CAAAACATGTGATTTTTGTAATAAACTCTTTATAAT SEQ ID NO:149.
Rattus norvegicus (rat liver) arginase 1 (Arg1),
(Boucher) ACCESSION NM_017134:
MSSKPKPIEIIGAPFSKGQPRGGVEKGPAALRKAGLVEKLKETEYNVRDH
GDLAFVDVPNDSPFQIVKNPRSVGKANEQLAAVVAETQKNGTISVVLGGD
HSMAIGSISGHARVHPDLCVIWVDAHTDINTPLTTSSGNLHGQPVAFLLK
ELKGKFPDVPGFSWVTPCISAKDIVYIGLRDVDPGEHYIIKTLGIKYFSM
TEVDKLGIGKVMEETFSYLLGRKKRPIHLSFDVDGLDPVFTPATGTPVVG
GLSYREGLYITEEIYKTGLLSGLDIMEVNPTLGKTPEEVTRTVNTAVPLT
LSCFGTKREGNHKPETDYLKPPK SEQ ID NO:150.
Bos taurus liver arginase (EST name: 1Abo21H10;
GenBank Acc: CB220450):
GCTGCCAAAGACATTGTGTATATTGGTCTGAGAGATGTGGACCCTGGGGA
ACACTATATTTTGAAAACTCTGGGAATTAAATACTTTTCAATGACTGAAG
TGGATAAACTGGGAATTGGCAAGGTGATGGAAGAAACATTCAGCTATCTA
CTAGGAAGAAAGAAAGGCCAATTCATTTGAGCTTTGATGTTGATGGACT
GGACCCATCTTTCACGCCAGCTACTGGCACACCAGTCCAGGGAGGTCTGA
CTTACAGAGAAGGTCTCTACATCACAGAAGAAATTTACAAAACAGGTTTA
CTCTCAGGATTAGATATAATGGAAGTGAATCCGTCTCTGGGGAAGACACC
AGAAGAAGTGACTCGAACAGTGAACACAACAGTAGCAATAACCATGGCTT
GCTTTGGGGTTGCTCGAGAGGGTAACCATAAACCTATTGATTACCTTAGC
CCACCAAAGTAAACATGGAATCATCATATAAAAAAGTCTCACAGCTAAAT
GACATAATTAGTAAATCTAATAAAGTTACAGTCATCGTCCCAA

SEQ ID NO:151.
35S-1
5'-CCT TCG CAA GAG CCT TCC TCT AT-3

SEQ ID NO:152.
ARG2-S2
5'-GAC ATC AGC ACC AAG GAT ATC A-3'

SEQ ID NO:153.
5'-CCTTCGCAAGACCCTTCCTCTATATAAGGAAGTTCATTTCATTTGGA
GAGAACACGGGGGACTCTAGAGGATCCCCGGGGGAGGTTCTTGTAGTAAA
CAAATATGAAGAGTGCTGGAAGTATGGGAATCAACTATATGCAGAAATTG
CTAACGTCAAATGTTCCAAAAGAAGTAGTCAAAAGAGGACAGGATCGTGT
TGTAGAGGCATCTCTTACACTTATTCGTGAAAGAGCAAAACTTAAGGGAG
AGCTTGTTCGTGGACTTGGAGGTGCAGTAGCGTCAACGTCACTTCTTGGA
ATTCCTCTGGGACACAACTCTTCATTTCTCCAGGGCCCTGCATTTGCTCC
TCCTCTTATACGAGAGGCTATTTGGTGTGGCAGTACAAACTCCACAACTG
AGGAAGGAAAAATATTAGATGATCAACGTGTCTTAACTGATGTTGGTGAT
CTGCCAGTACAAGAGTTACGAGACACAGGCATAGATGACGATAGGTTGAT
GAGTACAGTAAGTGAATCTGTCAAGCTAGTTATGGACGAGAATCCATTGC
GCCCCTTGGTGTTAGGGGGTGATCACTCTATATCCTATCCTGTTGTAAGA
GCTGTGTCTGAAAAGCTTGGAGGACCTGTTGATATCCTTCACCTTGATGC
TCATCCTGACATTTATGATGCATTTGAAGGAAACAAATACTCACATGCAT
CAAGCTTTGCACGAATAATGGAGGGTGGTTATGCTCGACGCCTTTTGCAA

```
GTTGGAATTAGATCAATTAATCTAGAAGGTCGAGAACAAGGAAAAAGGTT

TGGTGTGGAGCAATATGAAATGCGAACATTTTCCAGAGACAGACAATTTT

TGGAGAATCTGAACTTGGTGAAGGTGTAAAGGGCGTGTATATATCCGTGG

ATGTTGACTGTTTGGATCCAGCATTTGCTCCTGGAGTATCTCATTTTGAG

TCAGGCGGTCTCTCGTTCCGCGATGTTCTAAACATACTGCATAACCTTCA

AGGTGATATCGTTGGTGCTGATGTC-3' (1023 bp)

SEQ ID NO:154.
primer used for amplification of the sequence from
the transgene in ARG2-OE plants.
5'-CCTTCGCAAGACCCTTCCTCTAT-3

SEQ ID NO:155.
primer used for amplification of the sequence from
the transgene in ARG2-OE plants.
5'-TGATATCGTTGGTGCTGATGTC-3'

SEQ ID NO:156.
sequence from the 35S promoter in the vector
pBI121.
5'-CCTTCGCAAGACCCTTCCTCTATATAAGGAAGTTCATTTCATTTGGA

GAGAACACGGGGGACTCTAGAGGATCCCC-3'

SEQ ID NO:157.
P. taeda loblolly pine arginase AAK07744
TCLLGVPLGHNSSFLQGPAFAPPRIREAIWCGSTNSATEKGKELKDSRVL

SDAGDVPIQEMRDCGIEDERLMKTVSDSVKIVMEEPPLRPLVLGGDHSIS

YPVVKAVTDHLGGPVDILHLDAHPDIYDAFEGNKYSHASSFARIMEGGHA

RRLLQVGIRSITKEGREQGKRFGVEQYEMHSFSKDRDFLENLKLGEGVKG

VYISIDVDCLDPAFAPGVSHLEPGGLSFRGVMNLVQNLQGDIVAAADVVE

FNPQRDTVDGMTAMVAAKLVRELTSKMSKLAH

SEQ ID NO:158.
Lycopersicon esculentum (tomato) cystatin
AF198388.
ATTCACCACAACAGATGAGAGTGATTCGAAGTAGAGCAATACTGATAGTG

CTTTTTCTGGTTTCTGCGTTTGGGTTAAGCGAACAGGGAAAATCAGGAGG

ATTCTGCAGTGAAGAGATGGCTACTCTTGGTGGAGTTCATGATTCTCATG

GTTCCTCGCAGAACAGTGACGAGATCCATAGCCTTGCTAAATTTGCCGTA

GATGAGCATAATAAGAAGGAGAATGCAATGATTGAATTGGCCAGAGTAGT

GAAGGCGCAAGAACAAACTGTTGCAGGTAAACTGCACCACCTCACTCTTG

AGGTCATGGATGCTGGAAAAAAGAAACTCTATGAGGCTAAGGTCTGGGTC

AAACCATGGTTGAATTTTAAGGAACTTCAAGAGTTCAAGCATGTTGAAGA

CGTTCCTACCTTTACTTCTTCAGATCTAGGAGTTAAGCAAGTAGAGCAGA

ACAGTGGATTGAAATCAGTGCCTGTGCATGATCCTGTTGTTGAAGAAGCT

GCAGAGCATGCAATAAAGACCATCCAGCAGAGATCCAACTCTATACATCC

ATATAAACTACAAGAGATTGTTCATGCTAATGCTGAGATGGCTGATGATT

CTACAAAGCTTCATTTGGTCATCAAAACCAGCAGGGGAGGGAAGGAAGAG

AAGTTCAAAGTTCAAGTGCAGCACAATAATGAAGGTGCGTTCCACTTGAA

TCGTATGGAGCCTGACAACTAAGTTTGGGAGATCCTACGCCTCTTTAGAT

TTCTTTAGTTCATCTATGGAGCTATGGATCTGTTTCAAGTATAATAAGCA

TGTAACCAGCACAATATTTTTACTACTTGCTTTTGTTCATCTGAAGTTTG

TCTTCATCTAGTGGATTACTCTGATCCACCTTAGGTTGAGGGCATCTTTG

TCTTGTGTCACAGTTGTAATGTTTCAAGTATTCTGAACATAACTACTCGG

TATAAAGTAAAAAAAAAAAAAAAAAAA

SEQ ID NO:159.
Lycopersicon esculentum (tomato) cystatin
AF198388.
MRVIRSRAILIVLFLVSAFGLSEQGKSGGFCSEEMATLGGVHDSHGSSQN

SDEIHSLAKFAVDEHNKKENAMIELARVVKAQEQTVAGKLHHLTLEVMDA

GKKKLYEAKVWVKPWLNFKELQEFKHVEDVPTFTSSDLGVKQVEQNSGLK

SVPVHDPVVEEAAEHAIKTIQQRSNSIHPYKLQEIVHANAEMADDSTKLH

LVIKTSRGGKEEKFKVQVQHNNEGAFHLNRMEPDN

SEQ ID NO:160.
Petunia x hybrida cysteine proteinase inhibitor
AY662997
ACGAGGACTTTGGTTAGTCCAATATTTAAGAAGGAAAGAAAAAAGATAGA

GTACAGTTTACAGATGAGAGTAAATCGAAACGCAACAGTGTTTATTGCTT

TGAATCTGATTCTGTTTTTAGTTTTTGTGTTCACTGCGTTTGCATTAAGC

GGTCAAGAAAATACAGGGGGATTTTGTGGGGAAGAAGAAGAAAAAGGAAA

TAATTATATAGAGATGGCTTTACTTGGTGGAATTCGTGATTCGCATCCTG

AGTCTCAGAACAGTGATGAGATCCATAGCCTTGCTAAATTTGCTGTTGAT

GAACACAACAAGAAGGAGAATGCTATGTTTGAGCTGGCCAGAGTTGTGAA

GGCGAAAGAGCAAGTTGTTGCTGGTACACTGCATCATCTGACCCTCGAGG

TCGTAGATGCTGGAAAAAAGAAACTCTATGAAGCTAAGGTCTGGGTCAAA

CCGTGGTTGAATTTCAAGGAACTTCAAGAGTTCACACACGTTGAAGATGC

TCCAGCAATTACTTCATCAGATCTAGGTGTTAAGAAAGAAGAGCAATGCT

CTGGATTCAAATCAGTGCCGGTACATGATCCGGTTGTGCAAGAAGCTGCT

GAGCATGCAATTAAGACCATCCAGCAGAGATCCAACTCACTTCTTCCATA

TGAACTTCAAGAGATTGTTCATGCAAATGCTGAGATGATTGAGGACTCTA

CAAAGCTCCATATGCTCATCAAAACCAGCAGGGGAGGGAAGGAAGAGAAG

TTCAAAGTTCAAGTGCACCACAGCAACGAAGGTGCTTTCCACTTGAATCA

TATGGAGCCTGATCGCTCATAACTCTTGAACTAGTATTGGAGGTCCTTTA

CCTCTTCAAAGTGCTAAGAAATGTTCCACTATGGAAAGCTATGAGAGAGT

GCATGAACTCCCTTTAAAAGTAAATAAGCTTGTAAACCAGCACAACATTT

AAATTTCTGCCTGTACTTTATTATCTGAAGTTGGATTCTCTGCTTCTAAA

GTTCTAAAAAAAAAAAAAAAAAA

SEQ ID NO:161.
Petunia x hybrida cysteine proteinase inhibitor
MRVNRNATVFIALNLILFLVFVFTAFALSGQENTGGFCGEEEEKGNNYIE

MALLGGIRDSHPESQNSDEIHSLAKFAVDEHNKKENAMFELARVVKAKEQ

VVAGTLHHLTLEVVDAGKKKLYEAKVWVKPWLNFKELQEFTHVEDAPAIT

SSDLGVKKEEQCSGFKSVPVHDPVVQEAAEHAIKTIQQRSNSLLPYELQE

IVHANAEMIEDSTKLHMLIKTSRGGKEEKFKVQVHHSNEGAFHLNHMEPD

RS

SEQ ID NO:162
Complete amino acid sequence of (Lycopersicon
esculentum) tomato TD
MEFLCLAPTR SFSTNPKLTK SIPSDHTSTT SRIFTYQNMR
```

```
GSTMRPLALP LKMSPIVSVP DITAPVENVP AILPKVVPGE

LIVNKPTGGD SDELFQYLVD ILASPVYDVA IESPLELAEK

LSDRLGVNFY IKREDKQRVF SFKLRGAYNM MSNLSREELD

KGVITASAGN HAQGVALAGQ RLNCVAKIVM PTTTPQIKID

AVRALGGDVV LYGKTFDEAQ THALELSEKD GLKYIPPFDD

PGVIKGQGTI GTEINRQLKD IHAVFIPVGG GGLIAGVATF

FKQIAPNTKI IGVEPYGAAS MTLSLHEGHR VKLSNVDTFA

DGVAVALVGE YTFAKCQELI DGMVLVANDG ISAAIKDVYD

EGRNILETSG AVAIAGAAAY CEFYKIKNEN IVAIASGANM

DFSKLHKVTE LAGLGSGKEA LLATFMVEQQ GSFKTFVGLV

GSLNFTELTY RFTSERKNAL ILYRVNVDKE SDLEKMIEDM

KSSNMTTLNL SHNELVVDHL KHLVGGSANI SDEIFGEFIV

PEKAETLKTF LDAFSPRWNI TLCRYRNQGD INASLLMGFQ

VPQAEMDEFK NQADKLGYPY ELDNYNEAFN LVVSE

SEQ ID NO:163
Amino acid sequences identified for midgut TD
KMSPIVSVP DITAPVENVP AILPK PTGGD SDELFQYLVD

ILASPVYDVA IESPLELAEK GAYNM MSNLSREELD KGVITASAGN

HAQGVALAGQ R IVM PTTTPQIK ALGGDVV LYGKTFDEAQ

THALELSEKD GLK PPFDD PGVIKGQGTI GTEINRQLKD

IHAVFIPVGG GGLIAGVATF FKQIAPNTKI IGVEPYGAAS

MTLSLHEGHR LSNVDTFA DGVAVALVGE YTFAKCQELI

DGMVLVANDG ISAAIKDVYD EGRNILETSG AVAIAGAAAY

CEFYKIKNEN IVAIASGANM DFSK VTE LAGLGS GK

SEQ ID NO:164
LC-MS/MS analysis of tomato flower TD, which is
reported to be the most abundant protein in this
organ, identified the amino acid sequences:
KMSPIVSVP DITAPVENYP AILPK LGVNFY IKR LRGAYNM

MSNLSREELD KGVITASAGN HAQGVALAGQ R IVM PTTTPQIK

ALGGDVV LYGKTFDEAQ THALELSEKD GLKYIPPFDD

PGVIKGQGTI GTEINRQLKD IHAVFIPVGG GGLIAGVATF

FKQIAPNTKI IGVEPYGAAS MTLSLHEGHR VKLSNVDTFA

DGVAVALVGE YTFAKCQELI DGMVLVANDG ISAAIKDVYD

EGRNILETSG AVAIAGAAAY CEFYKIKNEN IVAIASGANM

DFSKLHKVTE LAGLGSGKEA LLATFMVEQQ GSFKTFVGLV

GSLNFTELTY R VNVDKE SDLEKMIEDM KSSNMTTLNL

SHNELVVDHL KHLVGGSANI SDEIFGEFIV PEKAETLKTF

LDAFSPR YRNQGD INASLLMGFQ VPQAEMDEFK NQADKLGYPY

ELDNYNEAFN LVVSE

SEQ ID NO:165
Accession No. BAB57600, threonine deaminase IlvA
homolog
MTTNTVTLQT AHIVSLGDIE EAKASIKPFI RRTPLIKSMY

LSQNITKGNV YLKLENMQFT GSFKFRGASN KINHLSDEQK

AKGIIGASAG NHAQGVALTA KLLGIDATIV MPETAPIAKQ

NATKGYGAKV ILKGKNFNET RLYMEELAKE NGMTIVHPYD

DKFVMAGQGT IGLEILDDIW NYNTVIVPVG GGGLIAGIAT

ALKSFNPSIH IIGVQAENVH GMAESFYKRA LTEHREDSTI

ADGCDVKVPG EKTYEVVKHL VDEFILVSEE EIEHAMQDLM

QRAKIITEGA GALPTAAILS GKIDKKWLEG KNVVALVSGG

NVDLTRVSGV IEHGLNIADT SKGVVG

SEQ ID NO:166
Accession No. NP_011009 Threonine deaminase,
Saccharomyces cerevisiae (baker's yeast)
MSATLLKQPL CTVVRQGKQS KVSGLNLLRL KAHLHRQHLS

PSLIKLHSEL KLDELQTDNT PDYVRLVLRS SVYDVINESP

ISQGVGLSSR LNTNVILKRE DLLPVFSFKL RGAYNMIAKL

DDSQRNQGVI ACSAGNHAQG VAFAAKHLKI PATIVMPVCT

PSIKYQNVSR LGSQVVLYGN DFDEAKAECA KLAEERGLTN

IPPFDHPYVI AGQGTVAMEI LRQVRTANKI GAVFVPVGGG

GLIAGIGAYL KRVAPHIKII GVETYDAATL HNSLQRNQRT

PLPVVGTFAD GTSVRMIGEE TFRVAQQVVD EVVLVNTDEI

CAAVKDIFED TRSIVEPSGA LSVAGMKKYI STVHPEIDHT

KNTYVPILSG ANMNFDRLFR VSERAVLGEG KEVFMLVTLP

DVPGAFKKMQ KIIHPRSVTE FSYRYNEHRN ESSSEVPKAY

IYTSFSVVDR EKEIKQVMQQ LNALGFEAVD ISDNELAKSH

GRYLVGGASK VPNERIISFE FPERPGALTR FLGGLSDSWN

LTLFHYRNHG ADIGKVLAGI SVPPRENLTF QKFLEDLGYT

YHDETDNTVY QKFLKY

SEQ ID NO:167
Accession No. YP_213797, Threonine deaminase,
Salmonella enterica subsp. enterica serovar
Choleraesuis str. SC-B67
MAESQPLSVA PEGAEYLRAV LRAPVYEAAQ VTPLQKMEKL

SSRLDNVILV KREDRQPVHS FKLRGAYAMM AGLTEEQKAH

GVITASAGNH AQGVAFSSAR LGVKSLIVMP KATADIKVDA

VRGFGGEVLL HGANFDEAKA KAIELAQQQG FTWVPPFDHP

MVIAGQGTLA LELLQQDSHL DRVFVPVGGG GLAAGVAVLI

KQLMPQIKVI AVEAEDSACL KAALEAGHPV DLPRVGLFAE

GVAVKRIGDE TERLCQEYLD DIVTVDSDAI CAAMKDLFED

VRAVAEPSGA LALAGMKKYI AQHNIRGERL AHVLSGANVN

FHGLRYVSER CELGEQREAL LAVTIPEEKG SFLKFCQLLG

GRMVTEFNYR FADAKNACIF VGVRVSQGLE ERKEIITQLC

DGGYSVVDLS DDEMAKLHVR YMVGGRPSKP LQERLYSFEF

PESPGALLKF LHTLGTHWNI SLFHYRSHGT DYGRVLAAFE

LGDHEPDFET RLHELGYECH DESNNPAFRF FLAG

SEQ ID NO:168
Accession No. NP_418220, Threonine deaminase,
Escherichia coli K12
```

```
MADSQPLSGA PEGAEYLRAV LRAPVYEAAQ VTPLQKMEKL
SSRLDNVILV KREDRQPVHS FKLRGAYAMM AGLTEEQKAH
GVITASAGNH AQGVAFSSAR LGVKALIVMP TATADIKVDA
VRGFGGEVLL HGANFDEAKA KAIELSQQQG FTWVPPFDHP
MVIAGQGTLA LELLQQDAHL DRVFVPVGGG GLAAGVAVLI
KQLMPQIKVI AVEAEDSACL KAALDAGHPV DLPRVGLFAE
GVAVKRIGDE TFRLCQEYLD DIITVDSDAI CAAMKDLFED
VRAVAEPSGA LALAGMKKYI ALHNIRGERL AHILSGANVN
FHGLRYVSER CELGEQREAL LAVTIPEEKG SFLKFCQLLG
GRSVTEFNYR FADAKNACIF VGVRLSRGLE ERKEILQMLN
DGGYSVVDLS DDEMAKLHVR YMVGGRPSHP LQERLYSFEF
PESPGALLRF LNTLGTYWNI SLFHYRSHGT DYGRVLAAFE
LGDHEPDFET RLNELGYDCH DETNNPAFRF FLAG

SEQ ID NO:169
Accession No. NP_417587, Threonine deaminase,
Escherichia coli K12 threonine deaminase,
catabolic, PLP-dependent
MHITYDLPVA IDDIIEAKQR LAGRIYKTGM PRSNYFSERC
KGEIFLKFEN MQRTGSFKIR GAFNKLSSLT DAEKRKGVVA
CSAGNHAQGV SLSCAMLGID GKVVMPKGAP KSKVAATCDY
SAEVVLHGDN FNDTIAKVSE IVEMEGRIFI PPYDDPKVIA
GQGTIGLEIM EDLYDVDNVI VPIGGGGLLA GIAVAIKSIN
PTIRVIGVQS ENVHGMAASF HSGEITTHRT TGTLADGCDV
SRPGNLTYEI VRELVDDIVL VSEDEIRNSM IALIQRNKVV
TEGAGALACA ALLSGKLDQY IQNRKTVSII SGGNIDLSRV
SQITGFVDA SEQ ID NO:170
GI:66360297, Threonine deaminase, Thermus
thermophilus
MPSLQDLYAA FRRIAPYTHR TPLLTSRLLD GLLGKRLLLK
AEHLQKTGSF KARGALSKAL ALENPKGLLA VSSGNHAQGV
AYAAQVLGVK ALVVMPEDAS PYKKACARAY GAEVVDRGVT
AKNREEVARA LQEETGYALI HPFDDPLVIA GQGTAGLELL
AQAGRMGVFP GAVLAPVGGG GLLAGLATAV KALSPTTLVL
GVEPEAADDA KRSLEAGRIL RLEAPPRTRA DGVRTLSLGE
RTFPILRERV DGILTVSEEA LLEAERLLFT RTKQVVEPTG
ALPLAAVLEH GARLPQTLAL LLSGGNRDFS P SEQ ID NO:171
Accession No. T09532, Threonine deaminase Cicer
arietinum (chickpea)
MLSTSTTNSS ILPFRSRASS STFIARPPAN FNSIFTTSVR
VFPISMSRYC VFPHTWERDH NVPGVPGVLR KVVPAAPIKN
KPTCADSDEL PEYLRDVLRS PVYDVVVESP VELTERLSDR
LGVNFYVKRE DRQRVFSFKL RGPYNMMSSL SHEEIDKGVI
TASAGNHAQG VPFPFPGRRL KCVAKIVMPT TTPNIKLDGV
RALGADVVLW GHTFDEAKTH AVELCEKDGL RTIPPFEDP VIKGQGTIGS EINRQIKRID AVFVPVGGGG LIAGVAAFFK
QIAPQTKIIV VEPYDAASMA LSVHAEHRAK LSNVDTFADG
ATVAVIGEYT FARCQDVVDA MVLVANDGIG AAIKDVFDEG
RNIVETSGAA GIAGMYCEMY RIKNDNMVGI VSGANMNFRK
LHKVSELAVL GSGHEALLGT YMPGQKGCFK TMAGLVHGSL
SFTEITYRFT SHRRSILVLM LKLEPWRYIE KMIEMMKYSG
VTVLNISHNE LAVIHGKHLV GGSAKVSDEV FVEFIIPEKA
DLKKFLEVLS PHWNLTLYRY RNQGDLKATI LMVIASFLCE
IVIRKNQIDD LGYPYEIDQY NDAFNLAVTE SEQ ID NO:172
Accession No. AAX22214, Threonine deaminase,
Nicotiana attenuata
MEVLCQAPAG NSNFACNPKF TAIRTRAISS NDTFKVISST
GNNKKMKGAI RTSIPKPSAL PLKVSQLSPS ADSMPVPASL
QDVEAGKLIE NNPSGGDTEE LFQYLVEILA SRVYDVAIDS
PLQNAAKLSK KLGVNFWIKR EDMQSVFSFK LRGAYNMMTK
LSKEQLERGV ITASAGNHAQ GVALGAQRLK CTATIVMPVT
TPEIKIEAVK NLDGKVVLHG DTFDKAQEHA LKLAEDEGLT
FIPPFDHPDV IIGQGTIGTE INRQLKDIHA VFVPVGGGGL
IAGVAAYFKR VAPHTKIIGV EPFGASSMTQ SLYHGERVKL
EQVDNFADGV AVALVGEETF RLCKDLIDGM VLVSNDAISA
AVKDVYDEGR NILETSGALA IAGAFAYCKY YNIKGENVVA
IASGANMDFS KLKLVVDLAD IGGQREALLA TFMPEEPGSF
KKFCELVGPM NITEFKYRYN SGRKQALVLY SVGVNTKSDL
ESMLERMKSS QLNTVNLTNN NLVKEHLRHL MGGRSEPSNE
IFCQFIFPEK PGALRKFLDA FSPRWNISLF HYREQGELDA
SVLVGFQVPK GEIEEFRVQA NNLGYSYEIE SLNEASQLIM E SEQ ID NO:173
Accession No. NP_187616, Threonine deaminase,
Arabidopsis thaliana (thale cress)
MNSVQLPTAQ SSLRSHIHRP SKPVVGFTHF SSRSRIAVAV
LSRDETSMTP PPPKLPLPRL KVSPNSLQYP AGYLGAVPER
TNEAENGSIA EAMEYLTNIL STKVYDIAIE SPLQLAKKLS
KRLGVRMYLK REDLQPVFSF KLRGAYNMMV KLPADQLAKG
VICSSAGNHA QGVALSASKL GCTAVIMPV TTPEIKWQAV
ENLGATVVLF GDSYDQAQAH AKIRAEEEGL TFIPPFDHPD
VIAGQGTVGM EITRQAKGPL HAIFVPVGGG GLIAGIAAYV
KRVSPEVKII GVEPADANAM ALSLHHGERV ILDQVGGFAD
GVAVKEVGEE TFRISRNLMD GVVLVTRDAI CASIKDMFEE
KRNILEPAGA LALAGAEAYC KYYGLKDVNV VAITSGANMN
FDKLRIVTEL ANVGRQQEAV LATLMPEKPG SFKQFCELVG
PMNISEFKYR CSSEKEAVVL YSVGVHTAGE LKALQKRMES
SQLKTVNLTT SDLVKDHLRY LMGGRSTVGD EVLCRFTFPE
```

-continued
```
RPGALMNFLD SFSPRWNITL FHYRGQGETG ANVLVGIQVP

EQEMEEFKNR AKALGYDYFL VSDDDYFKLL MH

SEQ ID NO:174
Accession No. BAB59332, Threonine deaminase,
Thermoplasma volcanium GSS1
MENLEIPSFD EIIEAQRYLE GKVNRTPLIR STTIGKEYGA

DIYFKLENFQ KTGSFKSRGA IFRFSKLSED EKRHGVITAS

AGNHAQGVAY AAMINGIDAK IVMPEYTIPQ KVNAVISYGA

HVILKGSDYD EAHRYADEIA KQEGRIFIEA FNDRWVISGQ

GTIGLEIMED LPDVDIILVP VGGGGLISGI ALAAKHASNK

VKVIGIESEL SDSMKASLRE GKIVAHTSGV SICDGISVKY

PGVLTFDIAR KYYDDIVTVT EEYVSKAIYK LFERNKIVAE

PSGAVGLAAI MEGKVDVKGK KVAIVVSGGN INPLLMSKII

YKELENLGQL VRIECTIPDR PGNLYRIAMA IAENGGNIYH

AEVDNLRKET PPGFQSVTFT VNVRGQDHLD RIIGSLREMG

YLFRIT

SEQ ID NO:175
Accession No. NP_355906, Threonine deaminase,
Agrobacterium tumefaciens str. C58
MERTPLVRSE FLSERCGHPV HLKLETLQPI GAFKLRGAMN

AILSLDDAVR RRGLVTASTG NHGRAVAYAA AKLGIPATIC

MSALVPANKV EAIRMLGAEI RIVGRSQDDA QEEVERLTKN

RGLTAIPPFD HADVVAGQGT IGLEVVEDMP ELATILVPLS

GGGLAGGIAV AVKALKPRAR VIGISMERGA AMHASVKAGR

PVSVCEEETL ADSLGGGIGL ANRVTFALCK TLLDEIVLVS

EDEIATGICH ASREEDLRVE GAGAVGFAAI LAGKIAVSGP

AAIIVSGGNI DPAVHKTIID GGVA

SEQ ID NO:176
Accession No. NP_931843, Threonine deaminase,
Photorhabdus luminescens
MAACLPLTSS PNGAEYLKAA LSAPVYEVAQ VTPLQEMEKI

SARLGNTILV KREDRQPVHS FKLRGAYAMI ASLTEEQKNR

GVITASAGNH AQGVALSANR LGINSLIVMP VTTADIKVDA

VRSFGGKALL YGANFDEAKA KAIEMAQQEG YTFVPPFDHP

AVIAGQATLA MELLQQDVRL DRIFVPVGGG GLIAGVAVLI

KQLMPEIKII GVEAEDSACL KAAMEAGHPV DLPRVGLFAE

GVAVKRIGDE TFRLCQQYVD DVITVDSDAI CAAVKDLFED

VRAIAEPSGA LALAGLKKYV QQHQLRGERL AHILSGANVS

FHGLRYVSER CELGEQREAL LAVTIPEQKG SFLSFCQKLG

DRVVTEFNYR YTDADPDQAC LFVGVRLSRG EVERREIIEE

LRTAGYQVAD LSDDEMAKLH VRYMIGGRPS KPLKERLFSF

EFPESPGALL KELQTLGTHW NITLFHYRNY GTDYGRVLAA

FELSGAEVRF KRHLDALGYA YHDETDTPAF KFFLMCQNI

SEQ ID NO:177
Accession No. AAA22549, Threonine deaminase,
Bacillus subtilis
MKPLLKENSL IQVKHILKAH QNVKDVVIHT PLQRNDRLSE

RYECNIYLKR EDLQVVRSFK LRGAYHKMKQ LSSEQTENGV

VCASAGNHAQ GVAFSCKHLG IHGKIFMPST TPRQKVSQVE

LFGKGFIDII LTGDTFDDVY KSAAECCEAE SRTFIHPFDD

PDVMAGQGTL AVEILNDIDT EPHFLFASVG GGGLLSGVGT

YLKNVSPDTK VIAVEPAGAA SYFESNKAGH VVTLDKIDKF

VDGAAVKKIG EETFRTLETV VDDILLVPEG KVCTSILELY

NECAVVAEPA GALSVAALDL YKDQTKGKNV VCVVSGGNND

IGRMQEMKER SLIFEGLQHY FIVNFPQRAG ALREFLDEVL

GPNDDITRFE YTKKNNKSNG PALVGIELQN KADYGPLIER

MNKKPFHYVE VNKDEDLFHL LI

SEQ ID NO:178
Accession No. AAA34171, Threonine deaminase,
Lycopersicon esculentum (Solanum lycopersicum)
EFLCLAPTRS FSTNPKLTKS IPSDHTSTTS RIFTYQNMRG

STMRPLALPL KMSPIVSVPD ITAPVENVPA ILPKVVPGEL

IVNKPTGGDS DELFQYLVDI LASPVYDVAI ESPLELAEKL

SDRLGVNFYI KREDKQRVFS FKLRGAYNMM SNLSREELDK

GVITASAGNH AQGVALAGQR LNCVAKIVMP TTTPQIKIDA

VRALGGDVVL YGKTFDEAQT HALELSEKDG LKYIPPFDDP

GVIKGQGTIG TEINRQLKDI HAVFIPVGGG GLIAGVATFF

KQIAPNTKII GVEPYGAASM TLSLHEGHRV KLSNVDTFAD

GVAVALVGEY TFAKCQELID GMVLVANDGI SAAIKDVYDE

GRNILETSGA VAIAGAAAYC EFYKIKNENI VAIASGANMD

FSKLHKVTEL AGLGSGKEAL LATFMVEQQG SFKTFVGLVG

SLNFTELTYR FTSERKNALI LYRVNVDKES DLEKMIEDMK

SSNMTTLNLS HNELVVDHLK HLVGGSANIS DEIFGEFIVP

EKAETLKTFL DAFSPRWNIT LCRYRNQGDI NASLLMGFQV

PQAEMDEFKN QADKLGYPYE LDNYNEAFNL VVSE

SEQ ID NO:179
Accession No. AAA34705, Threonine deaminase
Saccharomyces cerevisiae (baker's yeast)
MSATLLKQPL CTVVRQGKQS KVSGLNLLRL KAHLHRQHLS

PSLIKLHSEL KLDELQTDNT PDYVRTNLRS SVYDVINESP

ISQGVGLSSR LNTNVILKRE DLLPVFSFKL RGAYNMIAKL

DDSQRNQGVI ACSAGNHAQG VAFAAKHLKI PATIVMPVCT

PSIKYQNVSR LGSQVVLYGN DFDEAKAECA KLAEERGLTN

IPPFDKPYVI AGQGTVAMEI LRQVRTANKI GAVFVPVGGG

GLIAGIGAYL KRVAPHIKTI GVETYDAATL HNSLQRNQRT

PLPVVGTFAD GTSVRMIGEE TFRVAQQVVD EVVLVNTDEI

CAAVKDIFED TRSIVEPSGA LSVAGMKKYI STVHPEIDHT

KNTYVPILSG ANMNFDRLRF VSERAVLGEG KEVFMLVTLP

DVPGAFKKMQ KIIHPRSVTE FSYRYNEHRH ESSSEVPKAY

IYTSFSVVDR EKEIKQVMQQ LNALGFEAVD ISDNELAKSH
```

```
GRYLVGGASK VPNERIISFE FPERPGALTR FLGGLSDSWN

LTLFHYRNHG ADIGKVLAGI SVPPRENLTF QKFLEDLGYT

YHDETDNTVY QKFLKY

SEQ ID NO:180
(Lycopersicon esculentum) tomato ID of Tp domain
and Cat domain
MEFLCLAPTR SFSTNPKLTK SIPSDHTSTT SRIFTYQNMR

GSTMRPLALP LKMSPIVSVP DITAPVENVP AILPKVVPGE

LIVNKPTGGD SDELFQYLVD ILASPVYDVA IESPLELAEK

LSDRLGVNFY IKREDKQRVF SFKLRGAYNM MSNLSREELD

KGVITASAGN HAQGVALAGQ RLNCVAKIVM PTTTPQIKID

AVRALGGDVV LYGKTFDEAQ THALELSEKD GLKYIPPFDD

PGVIKGQGTI GTEINRQLKD IHAVFIPVGG GGLIAGVATF

FKQIAPNTKI IGVEPYGAAS MTLSLHEGHR VKLSNVDTFA

DGVAVALVGE YTFAKCQELI DGMVLVANDG ISAAIKDVYD

EGRNILETSG AVAIAGAAAY CEFYKIKNEN IVAIASGANM

DFSK

SEQ ID NO:181
(Lycopersicon esculentum) tomato TD, Catalytic
Domain
KMSPIVSVP DITAPVENVP AILPKVVPGE LIVNKPTGGD

SDELFQYLVD ILASPVYDVA IESPLELAEK LSDRLGVNFY

IKREDKQRVF SFKLRGAYNM MSNLSREELD KGVITASAGN

HAQGVALAGQ RLNCVAKIVM PTTTPQIKID AVRALGGDVV

LYGKTFDEAQ THALELSEKD GLKYIPPFDD PGVIKGQGTI

GTEINRQLKD IHAVFIPVGG GGLIAGVATF FKQIAPNTKI

IGVEPYGAAS MTLSLHEGHR VKLSNVDTFA DGVAVALVGE

YTFAKCQELI DGMVLVANDG ISAAIKDVYD EGRNILETSG

AVAIAGAAAY CEFYKIKNEN IVAIASGANM DFSK

SEQ ID NO:182
(Lycopersicon esculentum) tomato TD, Sequence in
Catalytic Domain
KMSPIVSVP DITAPVENVP AILPK SEQ ID NO:183
(Lycopersicon esculentum) tomato TD, Sequence in
Catalytic Domain
PTGGD SDELFQYLVD ILASPVYDVA IESPLELAEK SEQ ID NO:184
(Lycopersicon esculentum) tomato TD, Sequence in
Catalytic Domain
GAYNM MSNLSREELD KGVITASAGN HAQGVALAGQ R SEQ ID NO:185
(Lycopersicon esculentum) tomato TD, Sequence in
Catalytic Domain
IVM PTTTPQIK SEQ ID NO:186
(Lycopersicon esculentum) tomato TD, Sequence in
Catalytic Domain
ALGGDVV LYGKTFDEAQ THALELSEKD GLK SEQ ID NO:187
(Lycopersicon esculentum) tomato TD, Sequence in
Catalytic Domain
PPFDD PGVIKGQGTI GTEINRQLKD IHAVFIPVGG GGLIAGVATF

FKQIAPNTKI

SEQ ID NO:188
(Lycopersicon esculentum) tomato TD, Sequence in
Catalytic Domain
IGVEPYGAAS MTLSLHEGHR SEQ ID NO:189
(Lycopersicon esculentum) tomato TD, Sequence in
Catalytic Domain
LSNVDTFA DGVAVALVGE YTFAKCQELI DGMVLVANDG

ISAAIKDVYD

SEQ ID NO:190
(Lycopersicon esculentum) tomato TD, Sequence in
Catalytic Domain
EGRNILETSG AVAIAGAAAY CEFYKIKNEN IVAISGANM DFSK
```

In some embodiments of the present invention, nucleic acid sequences corresponding to the arginase or threonine deaminase genes, their homologs, orthologs, paralogs, and mutants are provided as described above. The term "homology" when used in relation to nucleic acids or proteins refers to a degree of identity. There may be partial homology or complete homology. The terms "homolog," "homologue," "homologous," and "homology" when used in reference to amino acid sequence or nucleic acid sequence or a protein or a polypeptide refers to a degree of sequence identity to a given sequence, or to a degree of similarity between conserved regions, or to a degree of similarity between three-dimensional structures or to a degree of similarity between the active site, or to a degree of similarity between the mechanism of action, or to a degree of similarity between functions. In some embodiments, a homolog has a greater than 20% sequence identity to a given sequence. In some embodiments, a homolog has a greater than 40% sequence identity to a given sequence. In some embodiments, a homolog has a greater than 60% sequence identity to a given sequence. In some embodiments, a homolog has a greater than 70% sequence identity to a given sequence. In some embodiments, a homolog has a greater than 90% sequence identity to a given sequence. In some embodiments, a homolog has a greater than 95% sequence identity to a given sequence. In some embodiments, homology is determined by comparing internal conserved sequences to a given sequence. In some embodiments, homology is determined by comparing designated conserved functional regions. In some embodiments, means of determining homology are described in the Experimental section.

The term "ortholog" refers to a gene in different species that evolved from a common ancestral gene by speciation. In some embodiments, orthologs retain the same function. The term "paralog" refers to genes related by duplication within a genome. In some embodiments, paralogs evolve new functions. In further embodiments, a new function of a paralog is related to the original function.

In some embodiments, homologs may be used to generate recombinant DNA molecules that direct the expression of the encoded protein product in appropriate host cells. The term "recombinant" when made in reference to a nucleic acid molecule refers to a nucleic acid molecule that is comprised of segments of nucleic acid joined together by means of molecular biological techniques. The term "recombinant" when made in reference to a protein or a polypeptide refers to a protein molecule that is expressed using a recombinant nucleic acid molecule.

In some embodiments, the invention relates to the introduction of threonine deaminase expression in plants wherein the threonine deaminase is stable to acid and elevated temperatures. Acidophilic organisms such as *Thermoplasma* and *Picrophilus* which grow optimally at pH<2 and elevated temperatures (>50 C). A threonine deaminase for *Thermoplasma volcanium* is disclosed in SEQ ID NO: 174.

II. Arginase and Threonine Deaminase Family Genes, Coding Sequences and Polypeptides A. Nucleic Acid Sequences 1. *Lycopersicon esculentum* Arginase or Threonine Deaminase (Arginase or Threonine Deaminase Family) Genes The present invention provides plant arginase or threonine deaminase family genes and proteins including their homologs, orthologs, paralogs, variants and mutants. In some embodiments of the present invention, isolated nucleic acid sequences comprising arginase or threonine deaminase genes are provided. In some embodiments, isolated nucleic acid sequences comprising arginase or threonine deaminase family genes are provided. These sequences include sequences comprising arginase or threonine deaminase family cDNA and genomic sequences (for example, as shown in SEQ ID NOs:01-53).

2. Additional *Lycopersicon esculentum* and Plant Arginase Family Genes

The present invention provides nucleic acid sequences comprising additional arginase or threonine deaminase family genes. For example, some embodiments of the present invention provide polynucleotide sequences that produce polypeptides that are homologous to at least one of SEQ ID NOs:54-190. In some embodiments, the polypeptides are at least 95% (or more) identical to any of SEQ ID NOs: 54-190. Other embodiments of the present invention provide sequences assembled through EST sequences that produce polypeptides at least 95% or more (e.g., 95%, 98%, 99%) identical to at least one of SEQ ID NOs: 54-190. In other embodiments, the present invention provides nucleic acid sequences that hybridize under conditions ranging from low to high stringency to at least one of SEQ ID NOs:01-53, as long as the polynucleotide sequence capable of hybridizing to at least one of SEQ ID NOs:01-53 and encodes a protein that retains a desired biological activity of a guanidino substrate hydrolysis protein; in some preferred embodiments, the hybridization conditions are high stringency. In preferred embodiments, hybridization conditions are based on the melting temperature ($T_m$) of the nucleic acid binding complex and confer a defined "stringency" as explained above (See e.g., Wahl et al., Meth. Enzymol., 152:399-407 (1987), incorporated herein by reference).

In other embodiments of the present invention, alleles of arginase or threonine deaminase and other insect induced amino acid depleting genes are provided. In preferred embodiments, alleles result from a mutation, (i.e., a change in the nucleic acid sequence) and generally produce altered mRNAs or polypeptides whose structure or function may or may not be altered.

Any given gene may have none, one or many allelic forms. Common mutational changes that give rise to alleles are generally ascribed to deletions, additions, or insertions, or substitutions of nucleic acids. Each of these types of changes may occur alone, or in combination with the others, and at the rate of one or more times in a given sequence. Mutational changes in alleles also include rearrangements, insertions, deletions, additions, or substitutions in upstream regulatory regions.

In other embodiments of the present invention, the polynucleotide sequence encoding an arginase gene is extended utilizing the nucleotide sequences (e.g., SEQ ID NOs:01-53) in various methods known in the art to detect upstream sequences such as promoters and regulatory elements. For example, it is contemplated that for arginase, the sequences upstream are identified from the *Lycopersicon esculentum* genomic database. For other arginase or threonine deaminase family genes for which a database is available, the sequences upstream of the identified arginase or threonine deaminase, arginase or threonine deaminase family, and genes can also be identified.

In another embodiment, inverse PCR is used to amplify or extend sequences using divergent primers based on a known region (Triglia et al., Nucleic Acids Res., 16:8186 (1988), herein incorporated by reference). In yet another embodiment of the present invention, capture PCR (Lagerstrom et al., PCR Methods Applic., 1:111-19 (1991) herein incorporated by reference) is used. In still other embodiments, walking PCR is utilized. Walking PCR is a method for targeted gene walking that permits retrieval of unknown sequence (Parker et al., Nucleic Acids Res., 19:3055-60 (1991), herein incorporated by reference). The PROMOTERFINDER kit (Clontech) uses PCR, nested primers and special libraries to "walk in" genomic DNA. This process avoids the need to screen libraries and is useful in finding intron/exon junctions. In yet other embodiments of the present invention, add TAIL PCR is used as a preferred method for obtaining flanking genomic regions, including regulatory regions (Liu and Whittier, Genomics, February 10; 25(3):674-81 (1995); Liu et al., Plant J., September; 8(3):457-63 (1995), herein incorporated by reference). Preferred libraries for screening for full-length cDNAs include libraries that have been size-selected to include larger cDNAs. Also, random primed libraries are preferred, in that they contain more sequences that contain the 5' and upstream gene regions. A randomly primed library may be particularly useful in cases where an oligo d(T) library does not yield full-length cDNA. Genomic Libraries are useful for obtaining introns and extending 5' sequence.

3. Variant Arginase or Threonine Deaminase Family Genes

In some embodiments, the present invention provides isolated variants of the disclosed nucleic acid sequences encoding arginase or threonine deaminase family genes or related insect resistance genes, and the polypeptides encoded thereby; these variants include mutants, fragments, fusion proteins or functional equivalents of genes and gene protein products. The terms "variant" and "mutant" when used in reference to a polypeptide refer to an amino acid sequence that differs by one or more amino acids from another, usually related polypeptide. The variant may have "conservative" changes, wherein a substituted amino acid has similar structural or chemical properties. One type of conservative amino acid substitutions refers to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Preferred conservative amino acids substitution groups are: valine-leucine-isoleucine, phenylalanine-tyrosine, lysine-arginine, alanine-valine, and asparagine-glutamine. More rarely, a variant may have "non-conservative" changes (e.g., replacement of a glycine with a tryptophan). Similar minor variations may also include amino acid deletions or insertions (i.e., additions), or both. Guidance in determining which and how many amino acid residues may be substituted, inserted or deleted without abolishing biological activity may be found using computer programs well known in the art, for example, DNAStar software. Variants can be tested in functional assays. Preferred variants have less than 10%, and preferably less than 5%, and still more preferably less than 2% changes (whether substitutions, deletions, and so on).

Thus, nucleotide sequences of the present invention are engineered in order to introduce or alter an arginase or threonine deaminase coding sequence for a variety of reasons, including but not limited to initiating the production of guanidino substrate hydrolysis activity or threonone deaminase activity; alterations that modify the cloning, processing and/or expression of the gene product (such alterations include inserting new restriction sites and changing codon preference), as well as varying the protein function activity (such changes include but are not limited to differing binding kinetics to nucleic acid and/or protein or protein complexes or nucleic acid/protein complexes, differing binding inhibitor affinities or effectiveness, differing reaction kinetics, varying subcellular localization, and varying protein processing and/or stability).

a. Mutants.

Some embodiments of the present invention provide nucleic acid sequences encoding mutant forms of arginase or threonine deaminase proteins. In preferred embodiments, muteins result from mutation of the coding sequence, (i.e., a change in the nucleic acid sequence) and generally produce altered mRNAs or polypeptides whose structure or function may or may not be altered. Any given gene may have none, one, or many variant forms. Common mutational changes that give rise to variants are generally ascribed to deletions, additions or substitutions of nucleic acids. Each of these types of changes may occur alone, or in combination with the others, and at the rate of one or more times in a given sequence.

Mutants of arginase or threonine deaminase genes can be generated by any suitable method well known in the art, including but not limited to EMS induced mutagenesis, site-directed mutagenesis, randomized "point" mutagenesis, and domain-swap mutagenesis in which portions of the arginase or threonine deaminase cDNA are "swapped" with the analogous portion of other arginase or threonine deaminase or amino acid depleting enzyme-encoding cDNAs (Back and Chappell, PNAS 93: 6841-6845, (1996), herein incorporated by reference).

It is contemplated that is possible to modify the structure of a peptide having an activity (e.g., such as a insect resistance activity), for such purposes as increasing synthetic activity or altering the affinity of the arginase or threonine deaminase protein for a binding partner or a kinetic activity. Such modified peptides are considered functional equivalents of peptides having an activity of an arginase or threonine deaminase activity as defined herein. A modified peptide can be produced in which the nucleotide sequence encoding the polypeptide has been altered, such as by substitution, deletion, or addition. In some preferred embodiments of the present invention, the alteration increases or decreases the effectiveness of the arginase or threonine deaminase and arginase or threonine deaminase gene product to exhibit a phenotype caused by altered guanidino substrate hydrolysis activity. In other words, construct "X" can be evaluated in order to determine whether it is a member of the genus of modified or variant arginase or threonine deaminase genes of the present invention as defined functionally, rather than structurally.

Moreover, as described above, mutant forms of arginase or threonine deaminase proteins are also contemplated as being equivalent to those peptides that are modified as set forth in more detail herein. For example, it is contemplated that isolated replacement of a leucine with an isoleucine or valine, an aspartate with a glutamate, a threonine with a serine, or a similar replacement of an amino acid with a structurally related amino acid (i.e., conservative mutations) will not have a major effect on the biological activity of the resulting molecule. Accordingly, some embodiments of the present invention provide nucleic acids comprising sequences encoding variants of arginase or threonine deaminase gene products disclosed herein containing conservative replacements, as well as the proteins encoded by such nucleic acids. More rarely, a mutant includes "nonconservative" changes (e.g., replacement of a glycine with a tryptophan). Analogous minor variations can also include amino acid deletions or insertions, or both. Guidance in determining which amino acid residues can be substituted, inserted, or deleted without abolishing biological activity can be found using computer programs (e.g., LASERGENE software, DNASTAR Inc., Madison, Wis.). Accordingly, other embodiments of the present invention provide nucleic acids comprising sequences encoding variants of arginase or threonine deaminase gene products disclosed herein containing non-conservative replacements where the biological activity of the encoded protein is retained, as well as the proteins encoded by such nucleic acids. SEQ ID NOs:01-53.

b. Directed Evolution.

Variants of arginase or threonine deaminase family genes or coding sequences may be produced by methods such as directed evolution or other techniques for producing combinatorial libraries of variants. Thus, the present invention further contemplates a method of generating sets of nucleic acids that encode combinatorial mutants of the arginase or threonine deaminase proteins, as well as truncation mutants, and is especially useful for identifying potential variant sequences (i.e., homologs) that possess the biological activity of the encoded arginase or threonine deaminase proteins. In addition, screening such combinatorial libraries is used to generate, for example, novel encoded arginase or threonine deaminase gene product homologs that possess novel binding or other kinetic specificities or other biological activities. The invention further provides sets of nucleic acids generated as described above, where a set of nucleic acids encodes combinatorial mutants of the arginase or threonine deaminase proteins, or truncation mutants, as well as sets of the encoded proteins. The invention further provides any subset of such nucleic acids or proteins, where the subsets comprise at least two nucleic acids or at least two proteins.

It is contemplated that arginase or threonine deaminase genes can be utilized as starting nucleic acids for directed evolution. These techniques can be utilized to develop encoded arginase or threonine deaminase product variants having desirable properties such as increased kinetic activity or altered binding affinity.

In some embodiments, artificial evolution is performed by random mutagenesis (e.g., by utilizing error-prone PCR to introduce random mutations into a given coding sequence). This method requires that the frequency of mutation be finely tuned. As a general rule, beneficial mutations are rare, while deleterious mutations are common. This is because the combination of a deleterious mutation and a beneficial mutation often results in an inactive enzyme. The ideal number of base substitutions for targeted gene is usually between 1.5 and 5 (Moore and Arnold, Nat. Biotech., 14, 458-67 (1996); Leung et al., Technique, 1:11-15 (1989); Eckert and Kunkel, PCR Methods Appl., 1:17-24 (1991); Caldwell and Joyce, PCR Methods Appl., 2:28-33 (1992); and Zhao and Arnold, Nuc. Acids. Res., 25:1307-08 (1997, all of which are herein incorporated by reference).

After mutagenesis, the resulting clones are selected for desirable activity (e.g., screened for abolishing or restoring insect resistance activity in a constitutive mutant, in a wild type background where insect resistance activity is required, as described above and below). Successive rounds of mutagenesis and selection are often necessary to develop enzymes with desirable properties. It should be noted that chosen mutations are carried over to the next round of mutagenesis.

In other embodiments of the present invention, the polynucleotides of the present invention are used in gene shuffling or special PCR procedures (e.g., Smith, Nature, 370:324-25 (1994); U.S. Pat. Nos. 5,837,458; 5,830,721; 5,811,238; 5,733,731, all of which are herein incorporated by reference). Gene shuffling involves random fragmentation of several mutant DNAs followed by their reassembly by PCR into full-length molecules. Examples of various gene shuffling procedures include, but are not limited to, assembly following DNase treatment, the staggered extension process (STEP), and random priming in vitro recombination.

c. Homologs

In some embodiments, the present invention provides isolated variants of the disclosed sequences encoding arginase or threonine deaminase or related insect resistances genes, and the polypeptides encoded thereby; these variants include mutants, fragments, fusion proteins or functional equivalents genes and protein products. The term "homology" when used in relation to nucleic acids or proteins refers to a degree of identity. There may be partial homology or complete homology. The following terms are used to describe the sequence relationships between two or more polynucleotides and between two or more polypeptides: "identity," "percentage identity," "identical," "reference sequence", "sequence identity", "percentage of sequence identity", and "substantial identity." "Sequence identity" refers to a measure of relatedness between two or more nucleic acids or proteins, and is described as a given as a percentage "of homology" with reference to the total comparison length. A "reference sequence" is a defined sequence used as a basis for a sequence comparison; a reference sequence may be a subset of a larger sequence, for example, the sequence that forms an active site of a protein or a segment of a full-length cDNA sequence or may comprise a complete gene sequence. Since two polynucleotides or polypeptides may each (1) comprise a sequence (i.e., a portion of the complete polynucleotide sequence) that is similar between the two polynucleotides, and (2) may further comprise a sequence that is divergent between the two polynucleotides, sequence comparisons between two (or more) polynucleotides are typically performed by comparing sequences of the two polynucleotides over a "comparison window" to identify and compare local regions of sequence similarity. A "comparison window," as used herein, refers to a conceptual segment of in internal region of a polypeptide. In one embodiment, a comparison window is at least 77 amino acids long. In another embodiment, a comparison window is at least 84 amino acids long. In another embodiment, conserved regions of proteins are comparison windows. In a further embodiment, an amino acid sequence for a conserved transmembrane domain is 24 amino acids. An example of a comparison window for a percent homology determination of the present invention is shown in FIG. 10 and described in Example 1. Calculations of identity may be performed by algorithms contained within computer programs such as the ClustalX algorithm (Thompson, et al. Nucleic Acids Res. 24, 4876-4882 (1997), herein incorporated by reference); MEGA2 (version 2.1) (Kumar, et al. Bioinformatics 17, 1244-1245 (2001); "GAP" (Genetics Computer Group, Madison, Wis.) and "ALIGN" (DNAStar, Madison, Wis., all of which are herein incorporated by reference).

For comparisons of nucleic acids, 20 contiguous nucleotide positions wherein a polynucleotide sequence may be compared to a reference sequence of at least 20 contiguous nucleotides and wherein the portion of the polynucleotide sequence in the comparison window may comprise additions or deletions (i.e., gaps) of 20 percent or less as compared to the reference sequence (which does not comprise additions or deletions) for optimal alignment of the two sequences. Optimal alignment of sequences for aligning a comparison window may be conducted by the local homology algorithm of Smith and Waterman (Smith and Waterman, Adv. Appl. Math. 2: 482 (1981)) by the homology alignment algorithm of Needleman and Wunsch (Needleman and Wunsch, J. Mol. Biol. 48:443 (1970), herein incorporated by reference), by the search for similarity method of Pearson and Lipman (Pearson and Lipman, Proc. Natl. Acad. Sci. (U.S.A.) 85:2444 (1988), herein incorporated by reference), by computerized implementations of these algorithms (GAP, BESTFIT, FASTA, and TFASTA in the Wisconsin Genetics Software Package Release 7.0, Genetics Computer Group, 575 Science Dr., Madison, Wis.), or by inspection, and the best alignment (i.e., resulting in the highest percentage of homology over the comparison window) generated by the various methods is selected. The term "sequence identity" means that two polynucleotide or two polypeptide sequences are identical (i.e., on a nucleotide-by-nucleotide basis or amino acid basis) over the window of comparison. The term "percentage of sequence identity" is calculated by comparing two optimally aligned sequences over the window of comparison, determining the number of positions at which the identical nucleic acid base (e.g., A, T, C, G, U, or I) or amino acid, in which often conserved amino acids are taken into account, occurs in both sequences to yield the number of matched positions, dividing the number of matched positions by the total number of positions in the window of comparison (i.e., the window size), and multiplying the result by 100 to yield the percentage of sequence identity. The terms "substantial identity" as used herein denotes a characteristic of a polynucleotide sequence, wherein the polynucleotide comprises a sequence that has at least 85 percent sequence identity, preferably at least 90 to 95 percent sequence identity, more usually at least 99 percent sequence identity as compared to a reference sequence over a comparison window of at least 20 nucleotide positions, frequently over a window of at least 25-50 nucleotides, wherein the percentage of sequence identity is calculated by comparing the reference sequence to the polynucleotide sequence which may include deletions or additions which total 20 percent or less of the reference sequence over the window of comparison. The reference sequence may be a subset of a larger sequence, for example, as a segment of the full-length sequences of the compositions claimed in the present invention.

Some homologs of encoded arginase or threonine deaminase family products have intracellular half-lives dramatically different than the corresponding wild-type protein. For example, the altered protein is rendered either more stable or less stable to proteolytic degradation or other cellular process that result in destruction of, or otherwise inactivate the encoded arginase or threonine deaminase family product.

Such homologs, and the genes that encode them, can be utilized to alter the activity of the encoded arginase or threonine deaminase by modulating the half-life of the protein. For instance, a short half-life can give rise to more transient arginase or threonine deaminase biological effects. Other homologs have characteristics which are either similar to wild-type arginase or threonine deaminase, or which differ in one or more respects from wild-type arginase or threonine deaminase.

d. Screening Gene Products

A wide range of techniques are known in the art for screening gene products of combinatorial libraries made by point mutations, and for screening cDNA libraries for gene products having a certain property. Such techniques are generally adaptable for rapid screening of the gene libraries generated by the combinatorial mutagenesis of arginase or threonine deaminase homologs. The most widely used techniques for screening large gene libraries typically comprise cloning the gene library into replicable expression vectors, transforming appropriate cells with the resulting library of vectors, and expressing the combinatorial genes under conditions in which detection of a desired activity facilitates relatively easy isolation of the vector encoding the gene whose product was detected. Each of the illustrative assays described below are amenable to high through-put analysis as necessary to screen large numbers of degenerate sequences created by combinatorial mutagenesis techniques.

Accordingly, in some embodiments of the present invention, the gene library is cloned into the gene for a surface membrane protein of a bacterial cell, and the resulting fusion protein detected by panning (WO 88/06630; Fuchs et al., BioTechnol., 9:1370-1371 (1991); and Goward et al., TIBS 18:136-140 (1992), all of which are herein incorporated by reference. In other embodiments of the present invention, fluorescently labeled molecules that bind encoded arginase or threonine deaminase can be used to score for potentially functional arginase or threonine deaminase. Cells are visually inspected and separated under a fluorescence microscope, or, where the morphology of the cell permits, separated by a fluorescence-activated cell sorter.

In an alternate embodiment of the present invention, the gene library is expressed as a fusion protein on the surface of a viral particle. For example, foreign peptide sequences are expressed on the surface of infectious phage in the filamentous phage system, thereby conferring two significant benefits. First, since these phages can be applied to affinity matrices at very high concentrations, a large number of phage can be screened at one time. Second, since each infectious phage displays the combinatorial gene product on its surface, if a particular phage is recovered from an affinity matrix in low yield, the phage can be amplified by another round of infection. The group of almost identical E. coli filamentous phages M13, fd, and f1 are most often used in phage display libraries, as either of the phage gIII or gVIII coat proteins can be used to generate fusion proteins without disrupting the ultimate packaging of the viral particle (See e.g., WO 90/02909; WO 92/09690; Marks et al., J. Biol. Chem., 267:16007-16010 (1992); Griffths et al., EMBO J., 12:725-734 (1993); Clackson et al., Nature, 352:624-628 (1991); and Barbas et al., Proc. Natl. Acad. Sci., 89:4457-4461 (1992), all of which are herein incorporated by reference).

In another embodiment of the present invention, the recombinant phage antibody system (e.g., RPAS, Pharmacia Catalog number 27-9400-01) is modified for use in expressing and screening of encoded arginase or threonine deaminase product combinatorial libraries. The pCANTAB 5 phagemid of the RPAS kit contains the gene that encodes the phage gIII coat protein. In some embodiments of the present invention, the arginase or threonine deaminase combinatorial gene library is cloned into the phagemid adjacent to the gIII signal sequence such that it is expressed as a gIII fusion protein. In other embodiments of the present invention, the phagemid is used to transform competent E. coli TG1 cells after ligation. In still other embodiments of the present invention, transformed cells are subsequently infected with M13KO7 helper phage to rescue the phagemid and its candidate arginase or threonine deaminase gene insert. The resulting recombinant phage contain phagemid DNA encoding a specific candidate arginase or threonine deaminase protein and display one or more copies of the corresponding fusion coat protein. In some embodiments of the present invention, the phage-displayed candidate proteins that display any property characteristic of an arginase or threonine deaminase protein are selected or enriched by panning. The bound phage is then isolated, and if the recombinant phages express at least one copy of the wild type gIII coat protein, they will retain their ability to infect E. coli. Thus, successive rounds of reinfection of E. coli and panning will greatly enrich for arginase or threonine deaminase.

In light of the present disclosure, other forms of mutagenesis generally applicable will be apparent to those skilled in the art in addition to the aforementioned rational mutagenesis based on conserved versus non-conserved residues. For example, arginase or threonine deaminase homologs can be generated and screened using, for example, alanine scanning mutagenesis and the like (Ruf et al., Biochem., 33:1565-1572 (1994); Wang et al., J. Biol. Chem., 269:3095-3099 (1994); Balint Gene 137:109-118 (1993); Grodberg et al., Eur. J. Biochem., 218:597-601 (1993); Nagashima et al., J. Biol. Chem., 268:2888-2892 (1993); Lowman et al., Biochem., 30:10832-10838 (1991); and Cunningham et al., Science, 244:1081-1085 (1989), all of which are herein incorporated by reference), by linker scanning mutagenesis (Gustin et al., Virol., 193:653-660 (1993); Brown et al., Mol. Cell. Biol., 12:2644-2652 (1992); McKnight and Kingsbury Science, July 23; 217(4557):316-24 (1982), all of which are herein incorporated by reference) or by saturation mutageriesis (Myers et al., Science, 2; 232(4750):613-618 (1986); all of which are herein incorporated by reference).

e. Truncation Mutants of Arginase or Threonine Deaminase

In addition, the present invention provides isolated nucleic acid sequences encoding fragments of encoded arginase or threonine deaminase products (i.e., truncation mutants), and the polypeptides encoded by such nucleic acid sequences. In preferred embodiments, the arginase or threonine deaminase fragment is biologically active. In some embodiments of the present invention, when expression of a portion of an arginase or threonine deaminase protein is desired, it may be necessary to add a start codon (ATG) to the oligonucleotide fragment containing the desired sequence to be expressed. It is well known in the art that a methionine at the N-terminal position can be enzymatically cleaved by the use of the enzyme methionine aminopeptidase (MAP). MAP has been cloned from E. coli (Ben-Bassat et al., J. Bacteriol., 169:751-757 (1987), herein incorporated by reference) and Salmonella typhimurium and its in vitro activity has been demonstrated on recombinant proteins (Miller et al., Proc. Natl. Acad. Sci. USA, 84:2718-1722 (1990), herein incorporated by reference). Therefore, removal of an N-terminal methionine, if desired, can be achieved either in vivo by expressing such recombinant polypeptides in a host that produces MAP (e.g., E. coli or CM89 or S. cerevisiae), or in vitro by use of purified MAP.

f. Fusion Proteins Containing Arginase or Threonine Deaminase

The present invention also provides nucleic acid sequences encoding fusion proteins incorporating all or part of arginase or threonine deaminase, and the polypeptides encoded by such nucleic acid sequences. The term "fusion" when used in reference to a polypeptide refers to a chimeric protein containing a protein of interest joined to an exogenous protein fragment (the fusion partner). The term "chimera" when used in reference to a polypeptide refers to the expression product of two or more coding sequences obtained from different genes, that have been cloned together and that, after translation, act as a single polypeptide sequence. Chimeric polypeptides are also referred to as "hybrid" polypeptides. The coding sequences include those obtained from the same or from different species of organisms. The fusion partner may serve various functions, including enhancement of solubility of the polypeptide of interest, as well as providing an "affinity tag" to allow purification of the recombinant fusion polypeptide from a host cell or from a supernatant or from both. If desired, the fusion partner may be removed from the protein of interest after or during purification. In some embodiments, the fusion proteins have an arginase or threonine deaminase functional domain with a fusion partner. Accordingly, in some embodiments of the present invention, the coding sequences for the polypeptide (e.g., an arginase or threonine deaminase functional domain) is incorporated as a part of a fusion gene including a nucleotide sequence encoding a different polypeptide. It is contemplated that such a single fusion product polypeptide is able to enhance insect resistance activity, such that the transgenic plant produces altered insect resistance ratios.

In some embodiments of the present invention, chimeric constructs code for fusion proteins containing a portion of an arginase or threonine deaminase protein and a portion of another gene. In some embodiments, the fusion proteins have biological activity similar to the wild type arginase or threonine deaminase (e.g., have at least one desired biological activity of an arginase or threonine deaminase protein). In other embodiments, the fusion protein has altered biological activity.

In addition to utilizing fusion proteins to alter biological activity, it is widely appreciated that fusion proteins can also facilitate the expression and/or purification of proteins, such as the arginase or threonine deaminase protein of the present invention. Accordingly, in some embodiments of the present invention, an arginase or threonine deaminase protein is generated as a glutathione-S-transferase (i.e., GST fusion protein). It is contemplated that such GST fusion proteins enables easy purification of the arginase or threonine deaminase protein, such as by the use of glutathione-derivatized matrices (See e.g., Ausabel et al. (eds.), Current Protocols in Molecular Biology, John Wiley & Sons, NY (1991), herein incorporated by reference).

In another embodiment of the present invention, a fusion gene coding for a purification leader sequence, such as a poly-(His)/enterokinase cleavage site sequence at the N-terminus of the desired portion of an arginase or threonine deaminase protein allows purification of the expressed arginase or threonine deaminase fusion protein by affinity chromatography using a $Ni^{2+}$ metal resin. In still another embodiment of the present invention, the purification leader sequence is then subsequently removed by treatment with enterokinase (See e.g., Hochuli et al., J. Chromatogr., 411: 177 (1987); and Janknecht et al., Proc. Natl. Acad. Sci. USA, 88:8972, all of which are herein incorporated by reference).

In yet other embodiments of the present invention, a fusion gene coding for a purification sequence appended to either the N or the C terminus allows for affinity purification; one example is addition of a hexahistidine tag to the carboxy terminus of an arginase or threonine deaminase protein that is optimal for affinity purification.

Techniques for making fusion genes are well known. Essentially, the joining of various nucleic acid fragments coding for different polypeptide sequences is performed in accordance with conventional techniques, employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment of the present invention, the fusion gene can be synthesized by conventional techniques including automated DNA synthesizers. Alternatively, in other embodiments of the present invention, PCR amplification of gene fragments is carried out using anchor primers that give rise to complementary overhangs between two consecutive gene fragments that can subsequently be annealed to generate a chimeric gene sequence (See e.g., Current Protocols in Molecular Biology, supra, herein incorporated by reference).

B. Arginase and Threonine Deaminase Family Polypeptides

The present invention provides isolated arginase and threonine deaminase family polypeptides, as well as variants, homologs, mutants or fusion proteins thereof, as described above. In some embodiments of the present invention, the polypeptide is a naturally purified product, while in other embodiments it is a product of chemical synthetic procedures, and in still other embodiments it is produced by recombinant techniques using a prokaryotic or eukaryotic host (e.g., by bacterial, yeast, higher plant, insect and mammalian cells in culture). In some embodiments, depending upon the host employed in a recombinant production procedure, the polypeptide of the present invention is glycosylated or non-glycosylated. In other embodiments, the polypeptides of the invention also includes an initial methionine amino acid residue.

1. Purification of Arginase or Threonine Deaminase Polypeptides

The present invention provides purified arginase or threonine deaminase polypeptides as well as variants, homologs, mutants or fusion proteins thereof, as described above. In some embodiments of the present invention, arginase or threonine deaminase family polypeptides purified from recombinant organisms as described below are provided. In other embodiments, arginase or threonine deaminase and purified from recombinant bacterial extracts transformed with *Lycopersicon esculentum* arginase or threonine deaminase cDNA, and in particular any one or more of arginase or threonine deaminase are provided (as described in the Examples).

The present invention also provides methods for recovering and purifying arginase or threonine deaminase from recombinant cell cultures including, but not limited to, ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography.

The present invention further provides nucleic acid sequences having the coding sequence for an arginase or threonine deaminase protein (e.g., SEQ ID NOs:54-172) fused in frame to a marker sequence that allows for expression alone or for both expression and purification of the polypeptide of the present invention. A non-limiting example of a marker sequence is a hexahistidine tag that is supplied by a vector, for example, a pQE-30 vector which adds a hexahistidine tag to the N terminal of an arginase or threonine deaminase gene and which results in expression of the polypeptide in a bacterial host, or, for example, the marker sequence is a hemagglutinin (HA) tag when a mammalian host is used. The HA tag corresponds to an epitope derived from the influenza hemagglutinin protein (Wilson et al., Cell, 37:767 (1984), herein incorporated by reference).

2. Chemical Synthesis of Arginase or Threonine Deaminase and Arginase or Threonine Deaminase Family Polypeptides In an alternate embodiment of the invention, the coding sequence of arginase or threonine deaminase genes is synthesized, in whole or in part, using chemical methods well known in the art (See e.g., Caruthers et al., Nucl. Acids Res. Symp. Ser., 7:215-233 (1980); Crea and Horn, Nucl. Acids Res., May 24; 8(10):2331-2348 (1980); Matteucci and Caruthers, Tetrahedron Lett., 21:719 (1980); and Chow and Kempe, Nucl. Acids Res., 9:2807-2817 (1981), all of which are herein incorporated by reference). In other embodiments of the present invention, the protein itself is produced using chemical methods to synthesize either an entire arginas and arginase or threonine deaminasefamily amino acid sequence (for example, SEQ ID NOs:54-113) or a portion thereof. For example, peptides are synthesized by solid phase techniques, cleaved from the resin, and purified by preparative high performance liquid chromatography (See e.g., Creighton, Proteins Structures And Molecular Principles, W.H. Freeman and Co, New York N.Y. (1983), herein incorporated by reference). In other embodiments of the present invention, the composition of the synthetic peptides is confirmed by amino acid analysis or sequencing (See e.g., Creighton, supra, herein incorporated by reference).

Direct peptide synthesis can be performed using various solid-phase techniques (Roberge et al., Science, 269:202-204 (1995), herein incorporated by reference) and automated synthesis may be achieved, for example, using ABI 431A Peptide Synthesizer (Perkin Elmer) in accordance with the instructions provided by the manufacturer. Additionally, the amino acid sequence of arginase or threonine deaminase, or any part thereof, may be altered during direct synthesis and/or combined using chemical methods with other sequences to produce a variant polypeptide.

C. Expression of Cloned Arginase or Threonine Deaminase Genes

1. Vectors for Production of an Arginase or Threonine Deaminase Family Polypeptide The nucleic acid sequences of the present invention may be employed for producing polypeptides by recombinant techniques. Thus, for example, the nucleic acid sequence may be included in any one of a variety of expression vectors for expressing a polypeptide. The terms "expression vector" or "expression cassette" refer to a recombinant DNA molecule containing a desired coding sequence and appropriate nucleic acid sequences necessary for the expression of the operably linked coding sequence in a particular host organism. Nucleic acid sequences necessary for expression in prokaryotes usually include a promoter, an operator (optional), and a ribosome binding site, often along with other sequences. Eukaryotic cells are known to utilize promoters, enhancers, and termination and polyadenylation signals.

In some embodiments of the present invention, vectors include, but are not limited to, chromosomal, nonchromosomal and synthetic DNA sequences (e.g., derivatives of plant tumor sequences, T-DNA sequences, derivatives of SV40, bacterial plasmids, phage DNA; baculovirus, yeast plasmids, vectors derived from combinations of plasmids and phage DNA, and viral DNA such as vaccinia, adenovirus, fowl pox virus, and pseudorabies). It is contemplated that any vector may be used as long as it is replicable and viable in the host.

In particular, some embodiments of the present invention provide recombinant constructs comprising one or more of the nucleic sequences as broadly described above (e.g., SEQ ID NOs:01-53). In some embodiments of the present invention, the constructs comprise a vector, such as a plasmid or eukaryotic vector, or viral vector, into which a nucleic acid sequence of the invention has been inserted, in a forward or reverse orientation. In preferred embodiments of the present invention, the appropriate nucleic acid sequence is inserted into the vector using any of a variety of procedures. In general, the nucleic acid sequence is inserted into an appropriate restriction endonuclease site(s) by procedures known in the art.

Large numbers of suitable vectors are known to those of skill in the art, and are commercially available. Such vectors include, but are not limited to, the following vectors: 1) Bacterial—pYeDP60, pQE70, pQE60, pQE-9 (Qiagen), pBS, pD10, phagescript, psiX174, pbluescript SK, pBSKS, pNH8A, pNH16a, pNH18A, pNH46A (Stratagene); ptrc99a, pKK23-3, pKK233-3, pDR540, pRIT5 (Pharmacia); and 2) Eukaryotic—pMLBART, *Agrobacterium tumefaciens* strain GV3101, pSV2CAT, pOG44, PXT1, pSG (Stratagene) pSVK3, pBPV, pMSG, and pSVL (Pharmacia). Any other plasmid or vector may be used as long as they are replicable and viable in the host.

In some preferred embodiments of the present invention, plant expression vectors comprise an origin of replication, a suitable promoter and enhancer, and also any necessary ribosome binding sites, polyadenylation sites, splice donor and acceptor sites, transcriptional termination sequences, and 5' flanking nontranscribed sequences for expression in plants. In other embodiments, DNA sequences derived from the SV40 splice, and polyadenylation sites may be used to provide the required nontranscribed genetic elements.

In certain embodiments of the present invention, the nucleic acid sequence in the expression vector is operatively linked to an appropriate expression control sequence(s) (promoter) to direct mRNA synthesis. Promoters useful in the present invention include, but are not limited to, the LTR or SV40 promoter, the *E. coli* lac or trp, the phage lambda $P_L$ and $P_R$, T3 and T7 promoters, and the cytomegalovirus (CMV) immediate early, herpes simplex virus (HSV) thymidine kinase, and mouse metallothionein-I promoters and other promoters known to control expression of gene in prokaryotic or eukaryotic cells or their viruses. In other embodiments of the present invention, recombinant expression vectors include origins of replication and selectable markers permitting transformation of the host cell (e.g., dihydrofolate reductase or neomycin resistance for eukaryotic cell culture, or tetracycline or ampicillin resistance in *E. coli*).

In some embodiments of the present invention, transcription of the DNA encoding the polypeptides of the present invention by higher eukaryotes is increased by inserting an enhancer sequence into the vector. Enhancers are cis-acting elements of DNA, usually about from 10 to 300 bp that act on a promoter to increase its transcription. Enhancers useful in the present invention include, but are not limited to, the SV40 enhancer on the late side of the replication origin bp 100 to 270, a cytomegalovirus early promoter enhancer, the polyoma enhancer on the late side of the replication origin, and adenovirus enhancers.

In other embodiments, the expression vector also contains a ribosome binding site for translation initiation and a transcription terminator. In still other embodiments of the present invention, the vector may also include appropriate sequences for amplifying expression.

2. Host Cells for Production of an Arginase or Threonine Deaminase Family Proteins In a further embodiment, the present invention provides host cells containing the above-described constructs. The term "host cell" refers to any cell capable of replicating and/or transcribing and/or translating a heterologous gene. Thus, a "host cell" refers to any eukaryotic or prokaryotic cell (e.g., plant cells, algal cells such as *C. reinhardtii*, bacterial cells such as *E. coli*, yeast cells, mammalian cells, avian cells, amphibian cells, fish cells, and insect cells), whether located in vitro or in vivo. For example, host cells may be located in a transgenic plant. In some embodiments of the present invention, the host cell is a higher eukaryotic cell (e.g., a plant cell). In other embodiments of the present invention, the host cell is a lower eukaryotic cell (e.g., a yeast cell). The terms "eukaryotic" and "eukaryote" are used in it broadest sense. It includes, but is not limited to, any organisms containing membrane bound nuclei and membrane bound organelles. Examples of eukaryotes include but are not limited to animals, plants, alga, diatoms, and fungi.

In still other embodiments of the present invention, the host cell can be a prokaryotic cell (e.g., a bacterial cell). The terms "prokaryote" and "prokaryotic" are used in it broadest sense. It includes, but is not limited to, any organisms without a distinct nucleus. Examples of prokaryotes include but are not limited to bacteria, blue-green algae, archaebacteria, actinomycetes and mycoplasma. In some embodiments, a host cell is any microorganism. As used herein the term "microorganism" refers to microscopic organisms and taxonomically related macroscopic organisms within the categories of algae, bacteria, fungi (including lichens), protozoa, viruses, and subviral agents. Specific examples of host cells include, but are not limited to, *Escherichia coli, Salmonella typhimurium, Bacillus subtilis*, and various species within the genera *Pseudomonas, Streptomyces*, and *Staphylococcus*, as well as *Saccharomycees cerivisiae, Schizosaccharomycees pombe, Drosophila* S2 cells, Spodoptera Sf9 cells, Chinese hamster ovary (CHO) cells, COS-7 lines of monkey kidney fibroblasts, (Gluzman, Cell 23:175 (1981), herein incorporated by reference), 293T, C127, 3T3, HeLa and BHK cell lines, NT-1 (tobacco cell culture line), root cell and cultured roots in rhizosecretion (Gleba et al., Proc Natl Acad Sci USA 96: 5973-5977 (1999), herein incorporated by reference).

The constructs in host cells can be used in a conventional manner to produce the gene product encoded by the recombinant sequence. In some embodiments, introduction of the construct into the host cell can be accomplished by calcium phosphate transfection, DEAE-Dextran mediated transfection, or electroporation (See e.g., Davis et al., Basic Methods in Molecular Biology, (1986), herein incorporated by reference). Alternatively, in some embodiments of the present invention, the polypeptides of the invention can be synthetically produced by conventional peptide synthesizers.

Proteins can be expressed in eukaryotic cells, yeast, bacteria, or other cells under the control of appropriate promoters. Cell-free translation systems can also be employed to produce such proteins using RNAs derived from the DNA constructs of the present invention. Appropriate cloning and expression vectors for use with prokaryotic and eukaryotic hosts are described by Sambrook, et al., Molecular Cloning: A Laboratory Manual, Second Edition, Cold Spring Harbor, N.Y., (1989), herein incorporated by reference.

In some embodiments of the present invention, following transformation of a suitable host strain and growth of the host strain to an appropriate cell density, the selected promoter is induced by appropriate means (e.g., temperature shift or chemical induction) and cells are cultured for an additional period. In other embodiments of the present invention, cells are typically harvested by centrifugation, disrupted by physical or chemical means, and the resulting crude extract retained for further purification. In still other embodiments of the present invention, microbial cells employed in expression of proteins can be disrupted by any convenient method, including freeze-thaw cycling, sonication, mechanical disruption, or use of cell lysing agents.

III. Methods of Modifying Insect Resistance Phenotype by Manipulating Expression of an Arginase or Threonine Deaminase The present invention also provides methods of using arginase or threonine deaminase family genes for producing transgenic plants with an additional arginase or threonine deaminase gene. In one embodiment, arginase or threonine deaminase genes, ex. at least 51% identical to SEQ ID NO:01, are utilized to alter arginine levels in plants. In some embodiments, arginase gene sequences are used to control levels of plant arginine. In yet other embodiments, arginase gene sequences are overexpressed in plants.

The present invention provides transgenic plants overexpressing arginase or threonine deaminase genes. In some embodiments, transgenic plants are one or more of the following: Solanaceae, Brassicaceae, Poaceae and Coniferales. In some embodiments the transgenic plant is a tomato plant. In some embodiments the transgenic tomato plant is one or more of a Micro-Tom and a Castlemart. In some embodiments the transgenic plant is a crop plant. In some embodiments the transgenic plant is a woody plant. In some embodiments the woody plant is one or of the following: a *Pinus*, a *Picea*, and a *Populus*.

In other embodiments, arginase or threonine deaminase gene sequences are utilized to alter insect resistance phenotype, and/or to control the ratio of various insect resistance in a host. In yet other embodiments, arginase or threonine deaminase gene sequences are utilized to confer an insect resistance phenotype, and/or to decrease an insect resistance phenotype or to increase the production of a particular insect resistance, or to promote the production of novel insect resistance pigments. Thus, it is contemplated that nucleic acids encoding an arginase or threonine deaminase polypeptide of the present invention may be utilized to either increase or decrease the level of arginase or threonine deaminase mRNA and/or protein in transfected cells as compared to the levels in wild-type cells. In some embodiments, the present invention provides methods to over-ride an insect resistance phenotype, and/or to promote overproduction of an insect resistance, in plants that require insect resistance, by disrupting the function of at least one arginase or threonine deaminase gene in the plant. In these embodiments, the function of at least one arginase or threonine deaminase gene is disrupted by any effective technique, including but not limited to antisense, co-suppression, and RNA interference, as is described above and below.

In yet other embodiments, the present invention provides methods to alter an insect resistance phenotype and/or add a insect resistance in plants in which insect resistance is not usually found and/or add a novel or rare insect resistance in plants in which insect resistance is not otherwise found, by expression of at least one heterologous arginase or threonine deaminase gene. Thus, in some embodiments, nucleic acids comprising coding sequences of at least one arginase or threonine deaminase gene are used to transform plants without a pathway for producing a particular insect resistance. It is contemplated that some particular plant species or cultivars do not have any arginase or threonine deaminase resistance genes; for these plants, it is necessary to transform a plant with the necessary arginase or threonine deaminase genes required to confer the preferred insect resistance profile phenotype.

It is contemplated that other particular plant species or cultivars may possess at least one arginase or threonine deaminase resistance gene; thus, for these plants, it is necessary to transform a plant with those arginase or threonine deaminase genes that can interact with endogenous arginase or threonine deaminase and genes in order to confer a preferred insect resistance profile phenotype.

The presence of arginase or threonine deaminase genes in a species or cultivar can be tested by a number of ways, including but not limited to using probes from genomic or cDNA arginase or threonine deaminase coding sequences, or by using antibodies specific to arginase or threonine deaminase polypeptides. The additional arginase or threonine deaminase gene(s) needed to confer the desired phenotype can then be transformed into a plant to confer the phenotype. In these embodiments, plants are transformed with arginase or threonine deaminase genes as described above and below.

In some embodiments, the sequences are used for research purposes. For example, nucleic acid sequences comprising coding sequences of an arginase or threonine deaminase gene or related insect resistance genes are used to discover other insect feeding induced amino acid depleting genes. In other embodiments, endogenous plant arginase or threonine deaminase genes are silenced, for example with antisense RNA or by cosuppression, and the effects on guanidino substrate hydrolysis activity observed.

In other embodiments, modifications to nucleic acid sequences encoding arginase or threonine deaminase genes are made, and the effects observed in vivo; for example, modified nucleic sequences encoding at least one arginase or threonine deaminase gene are utilized to transform plants in which endogenous arginase or threonine deaminase genes are silenced by antisense RNA technology, and the effects observed. In other embodiments, arginase or threonine deaminase genes, either unmodified or modified, are expressed in vitro translation and/or transcription systems, and the interaction of the transcribed and/or translation product with other system components (such as nucleic acids, proteins, lipids, carbohydrates, or any combination of any of these molecules) observed. As described above, in some embodiments, it is contemplated that the nucleic acids encoding an arginase or threonine deaminase polypeptide of the present invention may be utilized to decrease the level of arginase or threonine deaminase mRNA and/or protein in transfected cells as compared to the levels in wild-type cells. In some of these embodiments, the nucleic acid sequence encoding an arginase or threonine deaminase protein of the present invention is used to design a nucleic acid sequence encoding a nucleic acid product that interferes with the expression of the nucleic acid encoding an arginase or threonine deaminase polypeptide, where the interference is based upon a coding sequence of the encoded arginase or threonine deaminase polypeptide. Exemplary methods are described further below.

One method of reducing arginase or threonine deaminase expression utilizes expression of antisense transcripts. Antisense RNA has been used to inhibit plant target genes in a tissue-specific manner (e.g., van der Krol et al. (1988) Biotechniques 6:958-976, herein incorporated by reference). Antisense inhibition has been shown using the entire cDNA sequence as well as a partial cDNA sequence (e.g., Sheehy et al. (1988) Proc. Natl. Acad. Sci. USA 85:8805-8809; Cannon et al. (1990) Plant Mol. Biol. 15:39-47, herein incorporated by reference). There is also evidence that 3' non-coding sequence fragment and 5' coding sequence fragments, containing as few as 41 base-pairs of a 1.87 kb cDNA, can play important roles in antisense inhibition (Ch'ng et al. (1989) Proc. Natl. Acad. Sci. USA 86:10006-10010, herein incorporated by reference).

Accordingly, in some embodiments, an arginase or threonine deaminase encoding-nucleic acid of the present invention are oriented in a vector and expressed so as to produce antisense transcripts. To accomplish this, a nucleic acid segment from the desired gene is cloned and operably linked to a promoter such that the antisense strand of RNA will be transcribed. The expression cassette is then transformed into plants and the antisense strand of RNA is produced. The nucleic acid segment to be introduced generally will be substantially identical to at least a portion of the endogenous gene or genes to be repressed. The sequence, however, need not be perfectly identical to inhibit expression. The vectors of the present invention can be designed such that the inhibitory effect applies to other proteins within a family of genes exhibiting homology or substantial homology to the target gene.

Furthermore, for antisense suppression, the introduced sequence also need not be full length relative to either the primary transcription product or fully processed mRNA. Generally, higher homology can be used to compensate for the use of a shorter sequence. Furthermore, the introduced sequence need not have the same intron or exon pattern, and homology of non-coding segments may be equally effective. Normally, a sequence of between about 30 or 40 nucleotides and about full-length nucleotides should be used, though a sequence of at least about 100 nucleotides is preferred, a sequence of at least about 200 nucleotides is more preferred, and a sequence of at least about 500 nucleotides is especially preferred.

Catalytic RNA molecules or ribozymes can also be used to inhibit expression of the target gene or genes. It is possible to design ribozymes that specifically pair with virtually any target RNA and cleave the phosphodiester backbone at a specific location, thereby functionally inactivating the target RNA. In carrying out this cleavage, the ribozyme is not itself altered, and is thus capable of recycling and cleaving other molecules, making it a true enzyme. The inclusion of ribozyme sequences within antisense RNAs confers RNA-cleaving activity upon them, thereby increasing the activity of the constructs.

A number of classes of ribozymes have been identified. One class of ribozymes is derived from a number of small circular RNAs which are capable of self-cleavage and replication in plants. The RNAs replicate either alone (viroid RNAs) or with a helper virus (satellite RNAs). Examples include RNAs from avocado sunblotch viroid and the satellite RNAs from tobacco ringspot virus, lucerne transient streak virus, velvet tobacco mottle virus, *Solanum* nodiflorum mottle virus and subterranean clover mottle virus. The design and use of target RNA-specific ribozymes is described in Haseloff, et al. (1988) Nature 334:585-591. Ribozymes targeted to the mRNA of a lipid biosynthetic gene, resulting in a heritable increase of the target enzyme substrate, have also been described (Merlo A O et al. (1998) Plant Cell 10: 1603-1621, herein incorporated by reference).

Another method of reducing arginase or threonine deaminase expression utilizes the phenomenon of cosuppression or gene silencing (See e.g., U.S. Pat. No. 6,063,947, herein incorporated by reference). The phenomenon of cosuppression has also been used to inhibit plant target genes in a tissue-specific manner. Cosuppression of an endogenous gene using a full-length cDNA sequence as well as a partial cDNA sequence (730 bp of a 1770 bp cDNA) are known (e.g., Napoli et al. (1990) Plant Cell 2:279-289; van der Krol et al. (1990) Plant Cell 2:291-299; Smith et al. (1990) Mol. Gen. Genetics 224:477-481, herein incorporated by reference). Accordingly, in some embodiments the nucleic acid sequences encoding an arginase or threonine deaminase of the present invention are expressed in another species of plant to effect cosuppression of a homologous gene.

Generally, where inhibition of expression is desired, some transcription of the introduced sequence occurs. The effect may occur where the introduced sequence contains no coding sequence per se, but intron or untranslated sequences homologous to sequences present in the primary transcript of the endogenous sequence. The introduced sequence generally will be substantially identical to the endogenous sequence intended to be repressed. This minimal identity will typically be greater than about 65%, but a higher identity might exert a more effective repression of expression of the endogenous sequences. Substantially greater identity of more than about 80% is preferred, though about 95% to absolute identity would be most preferred. As with antisense regulation, the effect should apply to any other proteins within a similar family of genes exhibiting homology or substantial homology.

For cosuppression, the introduced sequence in the expression cassette, needing less than absolute identity, also need not be full length, relative to either the primary transcription product or fully processed mRNA. This may be preferred to avoid concurrent production of some plants that are overexpressers. A higher identity in a shorter than full-length sequence compensates for a longer, less identical sequence. Furthermore, the introduced sequence need not have the same intron or exon pattern, and identity of non-coding segments will be equally effective. Normally, a sequence of the size ranges noted above for antisense regulation is used.

An effective method to down regulate a gene is by hairpin RNA constructs. Guidance to the design of such constructs for efficient, effective and high throughput gene silencing have been described (Wesley S V et al. (2001) Plant S. 27: 581-590, herein incorporated by reference).

In still further embodiments, knockouts may be generated by homologous recombination. Generally, plant cells are incubated with a strain of *Agrobacterium* that contains a targeting vector in which sequences that are homologous to a DNA sequence inside the target locus are flanked by *Agrobacterium* transfer-DNA (T-DNA) sequences, as previously described (U.S. Pat. No. 5,501,967, herein incorporated by reference).

The term "*Agrobacterium*" refers to a soil-borne, Gram-negative, rod-shaped phytopathogenic bacterium which causes crown gall. The term "Agrobacteriurm" includes, but is not limited to, the strains *Agrobacterium tumefaciens*, (which typically causes crown gall in infected plants), and *Agrobacterium* rhizogens (which causes hairy root disease in infected host plants). Infection of a plant cell with *Agrobacterium* generally results in the production of opines (e.g., nopaline, agropine, octopine etc.) by the infected cell. Thus, *Agrobacterium* strains which cause production of nopaline (e.g., strain GV3101, LBA4301, C58, A208, etc.) are referred to as "nopaline-type" *Agrobacteria; Agrobacterium* strains which cause production of octopine (e.g., strain LBA4404, Ach5, B6, etc.) are referred to as "octopine-type" *Agrobacteria*; and *Agrobacterium* strains which cause production of agropine (e.g., strain EHA105, EHA101, A281, etc.) are referred to as "agropine-type" *Agrobacteria*.

One of skill in the art knows that homologous recombination may be achieved using targeting vectors that contain sequences that are homologous to any part of the targeted plant gene, whether belonging to the regulatory elements of the gene, or the coding regions of the gene. Homologous recombination may be achieved at any region of a plant gene so long as the nucleic acid sequence of regions flanking the site to be targeted is known.

A. Transgenic Plants, Seeds, and Plant Parts

Plants are transformed with at least one heterologous gene encoding an arginase or threonine deaminase gene, or encoding a sequence designed to decrease arginase or threonine deaminase gene expression, according to any procedure well known or developed in the art. It is contemplated that these heterologous genes, or nucleic acid sequences of the present invention and of interest, are utilized to increase the level of the polypeptide encoded by heterologous genes, or to decrease the level of the protein encoded by endogenous genes. It is contemplated that these heterologous genes, or nucleic acid sequences of the present invention and of interest, are utilized augment and/or increase the level of the protein encoded by endogenous genes. It is also contemplated that these heterologous genes, or nucleic acid sequences of the present invention and of interest, are utilized to provide a polypeptide encoded by heterologous genes. The term "transgenic" when used in reference to a plant or fruit or seed for example a "transgenic plant," "transgenic fruit," "transgenic seed," or a "transgenic host cell" refers to a plant or fruit or seed that contains at least one heterologous or foreign gene in one or more of its cells. The term "transgenic plant material" refers broadly to a plant, a plant structure, a plant tissue, a plant seed or a plant cell that contains at least one heterologous gene in one or more of its cells.

1. Plants

The methods of the present invention are not limited to any particular plant. Indeed, a variety of plants are contemplated, including but not limited to rice (*Oryza sativa*), tomato, peppers, cotton, barley, sorghum, sunflowers, rice, corn, wheat, *Brassica*, sunflower, marigolds, and soybean. The term "plant" is used in it broadest sense. It includes, but is not limited to, any species of woody, ornamental or decorative, crop or cereal, fruit or vegetable, fruit plant or vegetable plant, flower or tree, macroalga or microalga, phytoplankton and photosynthetic algae (e.g., green algae *Chlamydomonas reinhardtii*). It also refers to a uniclelluar plant (e.g. microalga) and a plurality of plant cells that are largely differentiated into a colony (e.g. volvox) or a structure that is present at any stage of a plant's development. Such structures include, but are not limited to, a fruit, a seed, a shoot, a stem, a leaf, a flower petal, etc. The term "plant tissue" includes differentiated and undifferentiated tissues of plants including those present in roots, shoots, leaves, pollen, seeds and tumors, as well as cells in culture (e.g., single cells, protoplasts, embryos, callus, etc.). Plant tissue may be in planta, in organ culture, tissue culture, or cell culture. The term "plant part" as used herein refers to a plant structure or a plant tissue. In some embodiments of the present invention transgenic plants are crop plants. The term "crop" or "crop plant" is used in its broadest sense. The term includes, but is not limited to, any species of plant or alga edible by humans or used as a feed for animals or fish or marine animals, or consumed by humans, or used by humans (natural pesticides), or viewed by humans (flowers) or any plant or alga used in industry or commerce or education.

2. Vectors

The methods of the present invention contemplate the use of a heterologous gene encoding an arginase or threonine deaminase gene, or encoding a sequence designed to decrease or increase arginase or threonine deaminase gene expression, as described previously. Heterologous genes include but are not limited to naturally occurring coding sequences, as well variants encoding mutants, variants, truncated proteins, and fusion proteins, as described above.

Heterologous genes intended for expression in plants are first assembled in expression cassettes comprising a promoter. Methods which are well known to or developed by those skilled in the art may be used to construct expression vectors containing a heterologous gene and appropriate transcriptional and translational control elements. These methods include in vitro recombinant DNA techniques, synthetic techniques, and in vivo genetic recombination. Exemplary techniques are widely described in the art (See e.g., Sambrook. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York, N.Y., herein incorporated by reference).

In general, these vectors comprise a nucleic acid sequence encoding an arginase or threonine deaminase gene, or encoding a sequence designed to decrease arginase or threonine deaminase gene expression, (as described above) operably linked to a promoter and other regulatory sequences (e.g., enhancers, polyadenylation signals, etc.) required for expression in a plant.

Promoters include but are not limited to constitutive promoters, tissue-, organ-, and developmentally-specific promoters, and inducible promoters. Examples of promoters include but are not limited to: constitutive promoter 35S of cauliflower mosaic virus; a wound-inducible promoter from tomato, leucine amino peptidase ("LAP," Chao et al., Plant Physiol 120: 979-992 (1999), herein incorporated by reference); a chemically-inducible promoter from tobacco, Pathogenesis-Related 1 (PR1) (induced by salicylic acid and BTH (benzothiadiazole-7-carbothioic acid S-methyl ester)); a tomato proteinase inhibitor II promoter (PIN2) or LAP promoter (both inducible with methyl jasmonate); a heat shock promoter (U.S. Pat. No. 5,187,267, herein incorporated by reference); a tetracycline-inducible promoter (U.S. Pat. No. 5,057,422, herein incorporated by reference); and seed-specific promoters, such as those for seed storage proteins (e.g., phaseolin, napin, oleosin, and a promoter for soybean beta conglycin (Beachy et al., EMBO J. 4: 3047-3053 (1985), herein incorporated by reference). All references cited herein are incorporated in their entirety.

The expression cassettes may further comprise any sequences required for expression of mRNA. Such sequences include, but are not limited to transcription terminators, enhancers such as introns, vital sequences, and sequences intended for the targeting of the gene product to specific organelles and cell compartments.

A variety of transcriptional terminators are available for use in expression of sequences using the promoters of the present invention. Transcriptional terminators are responsible for the termination of transcription beyond the transcript and its correct polyadenylation. Appropriate transcriptional terminators and those which are known to function in plants include, but are not limited to, the CaMV 35S terminator, the tml terminator, the pea rbcS E9 terminator, and the nopaline and octopine synthase terminator (See e.g., Odell et al., Nature 313:810 (1985); Rosenberg et al., Gene, 56:125 (1987); Guerineau et al., Mol. Gen. Genet., 262:141 (1991); Proudfoot, Cell, 64:671 (1991); Sanfacon et al., Genes Dev., 5:141; Mogen et al., Plant Cell, 2:1261 (1990); Munroe et al., Gene, 91:151 (1990); Ballas et al., Nucleic Acids Res. 17:7891 (1989); Joshi et al., Nucleic Acid Res., 15:9627 (1987), all of which are incorporated herein by reference).

In addition, in some embodiments, constructs for expression of the gene of interest include one or more of sequences found to enhance gene expression from within the transcriptional unit. These sequences can be used in conjunction with the nucleic acid sequence of interest to increase expression in plants. Various intron sequences have been shown to enhance expression, particularly in monocotyledonous cells. For example, the introns of the maize Adh1 gene have been found to significantly enhance the expression of the wild-type gene under its cognate promoter when introduced into maize cells (Callis et al., Genes Develop. 1: 1183 (1987), herein incorporated by reference). Intron sequences have been routinely incorporated into plant transformation vectors, typically within the non-translated leader.

In some embodiments of the present invention, the construct for expression of the nucleic acid sequence of interest also includes a regulator such as a nuclear localization signal (Kalderon et al., Cell 39:499 (1984); Lassner et al., Plant Molecular Biology 17:229 (1991)), a plant translational consensus sequence (Joshi, Nucleic Acids Research 15:6643 (1987)), an intron (Luehrsen and Walbot, Mol. Gen. Genet. 225:81 (1991)), and the like, operably linked to the nucleic acid sequence encoding an arginase or threonine deaminase gene.

In preparing the construct comprising the nucleic acid sequence encoding an arginase or threonine deaminase gene, or encoding a sequence designed to decrease arginase or threonine deaminase gene expression, various DNA fragments can be manipulated, so as to provide for the DNA sequences in the desired orientation (e.g., sense or antisense) orientation and, as appropriate, in the desired reading frame. For example, adapters or linkers can be employed to join the DNA fragments or other manipulations can be used to provide for convenient restriction sites, removal of superfluous DNA, removal of restriction sites, or the like. For this purpose, in vitro mutagenesis, primer repair, restriction, annealing, resection, ligation, or the like is preferably employed, where insertions, deletions or substitutions (e.g., transitions and transversions) are involved.

Numerous transformation vectors are available for plant transformation. The selection of a vector for use will depend upon the preferred transformation technique and the target species for transformation. For certain target species, different antibiotic or herbicide selection markers are preferred. Selection markers used routinely in transformation include the nptII gene which confers resistance to kanamycin and related antibiotics (Messing and Vierra, Gene 19: 259 (1982); Bevan et al., Nature 304:184 (1983), all of which are incorporated herein by reference), the bar gene which confers resistance to the herbicide phosphinothricin (White et al., Nucl Acids Res. 18:1062 (1990); Spencer et al., Theor. Appl. Genet. 79: 625 (1990), all of which are incorporated herein by reference), the hph gene which confers resistance to the antibiotic hygromycin (Blochlinger and Diggelmann, Mol. Cell. Biol. 4:2929 (1984, incorporated herein by reference)), and the dhfr gene, which confers resistance to methotrexate (Bourouis et al., EMBO J., 2:1099 (1983), herein incorporated by reference).

In some preferred embodiments, the Ti (T-DNA) plasmid vector is adapted for use in an *Agrobacterium* mediated transfection process (See e.g., U.S. Pat. Nos. 5,981,839; 6,051,757; 5,981,840; 5,824,877; and 4,940,838; all of which are herein incorporated by reference). Construction of recombinant Ti and Ri plasmids in general follows methods typically used with the more common vectors, such as pBR322. Additional use can be made of accessory genetic elements sometimes found with the native plasmids and sometimes constructed from foreign sequences. These may include but are not limited to structural genes for antibiotic resistance as selection genes.

There are two systems of recombinant Ti and Ri plasmid vector systems now in use. The first system is called the "cointegrate" system. In this system, the shuttle vector containing the gene of interest is inserted by genetic recombination into a non-oncogenic Ti plasmid that contains both the cis-acting and trans-acting elements required for plant transformation as, for example, in the pMLJ1 shuttle vector and the non-oncogenic Ti plasmid pGV3850. The use of T-DNA as a flanking region in a construct for integration into a Ti- or Ri-plasmid has been described in EPO No. 116,718 and PCT Application Nos. WO 84/02913, 02919 and 02920 all of which are herein incorporated by reference). See also Herrera-Estrella, Nature 303:209-213 (1983); Fraley et al., Proc. Natl. Acad. Sci, USA 80:4803-4807 (1983); Horsch et al., Science 223:496-498 (1984); and DeBlock et al., EMBO J. 3:1681-1689 (1984), all of which are herein incorporated by reference).

The second system is called the "binary" system in which two plasmids are used; the gene of interest is inserted into a shuttle vector containing the cis-acting elements required for plant transformation. The other necessary functions are provided in trans by the non-oncogenic Ti plasmid as exemplified by the pBIN19 shuttle vector and the non-oncogenic Ti plasmid PAL4404. Some of these vectors are commercially available. In other embodiments of the invention, the nucleic acid sequence of interest is targeted to a particular locus on the plant genome. Site-directed integration of the nucleic acid sequence of interest into the plant cell genome may be achieved by, for example, homologous recombination using *Agrobacterium*-derived sequences. Generally, plant cells are incubated with a strain of *Agrobacterium* which contains a targeting vector in which sequences that are homologous to a DNA sequence inside the target locus are flanked by *Agrobacterium* transfer-DNA (T-DNA) sequences, as previously described (U.S. Pat. No. 5,501,967 herein incorporated by reference). One of skill in the art knows that homologous recombination may be achieved using targeting vectors that contain sequences that are homologous to any part of the targeted plant gene, whether belonging to the regulatory elements of the gene, or the coding regions of the gene. Homologous recombination may be achieved at any region of a plant gene so long as the nucleic acid sequence of regions flanking the site to be targeted is known. *Agrobacterium tumefaciens* is a common soil bacterium that causes crown gall disease by transferring some of its DNA to the plant host. The transferred DNA (T-DNA) is stably integrated into the plant genome, where its expression leads to the synthesis of plant hormones and thus to the tumorous growth of the cells. A putative macromolecular complex forms in the process of T-DNA transfer out of the bacterial cell into the plant cell.

In yet other embodiments, the nucleic acids of the present invention is utilized to construct vectors derived from plant (+) RNA viruses (e.g., brome mosaic virus, tobacco mosaic virus, alfalfa mosaic virus, cucumber mosaic virus, tomato mosaic virus, and combinations and hybrids thereof). Generally, the inserted arginase or threonine deaminase polynucleotide can be expressed from these vectors as a fusion protein (e.g., coat protein fusion protein) or from its own subgenomic promoter or other promoter. Methods for the construction and use of such viruses are described in U.S. Pat. Nos. 5,846,795; 5,500,360; 5,173,410; 5,965,794; 5,977,438; and 5,866,785, all of which are incorporated herein by reference.

In some embodiments of the present invention, where the nucleic acid sequence of interest is introduced directly into a plant. One vector useful for direct gene transfer techniques in combination with selection by the herbicide Basta (or phosphinothricin) is a modified version of the plasmid pCIB246, with a CaMV 35S promoter in operational fusion to the *E. coli* GUS gene and the CaMV 35S transcriptional terminator (WO 93/07278).

3. Transformation Techniques

Once a nucleic acid sequence encoding an arginase or threonine deaminase gene is operatively linked to an appropriate promoter and inserted into a suitable vector for the particular transformation technique utilized (e.g., one of the vectors described above), the recombinant DNA described above can be introduced into the plant cell in a number of art-recognized ways. Those skilled in the art will appreciate that the choice of method might depend on the type of plant targeted for transformation. In some embodiments, the vector is maintained episomally. In other embodiments, the vector is integrated into the genome.

In some embodiments, direct transformation in the plastid genome is used to introduce the vector into the plant cell (See e.g., U.S. Pat. Nos. 5,451,513; 5,545,817; 5,545,818; PCT application WO 95/16783 all of which are incorporated herein by reference). The basic technique for chloroplast transformation involves introducing regions of cloned plastid DNA flanking a selectable marker together with the nucleic acid encoding the RNA sequences of interest into a suitable target tissue (e.g., using biolistics or protoplast transformation with calcium chloride or PEG). The 1 to 1.5 kb flanking regions, termed targeting sequences, facilitate homologous recombination with the plastid genome and thus allow the replacement or modification of specific regions of the plastome. Initially, point mutations in the chloroplast 16S rRNA and rps12 genes conferring resistance to spectinomycin and/or streptomycin are utilized as selectable markers for transformation (Svab et al., PNAS, 87:8526 (1990); Staub and Maliga, Plant Cell, 4:39 (1992), all of which are incorporated herein by reference). The presence of cloning sites between these markers allowed creation of a plastid targeting vector introduction of foreign DNA molecules (Staub and Maliga, EMBO J., 12:601 (1993)). Substantial increases in transformation frequency are obtained by replacement of the recessive rRNA or r-protein antibiotic resistance genes with a dominant selectable marker, the bacterial aadA gene encoding the spectinomycin-detoxifying enzyme aminoglycoside-3'-adenyltransferase (Svab and Maliga, PNAS, 90:913 (1993)). Other selectable markers useful for plastid transformation are known in the art and encompassed within the scope of the present invention. Plants homoplasmic for plastid genomes containing the two nucleic acid sequences separated by a promoter of the present invention are obtained, and are preferentially capable of high expression of the RNAs encoded by the DNA molecule.

In other embodiments, vectors useful in the practice of the present invention are microinjected directly into plant cells by use of micropipettes to mechanically transfer the recombinant DNA (Crossway, Mol. Gen. Genet, 202:179 (1985)). In still other embodiments, the vector is transferred into the plant cell by using polyethylene glycol (Krens et al., Nature, 296:72 (1982); Crossway et al., BioTechniques, 4:320 (1986)); fusion of protoplasts with other entities, either minicells, cells, lysosomes or other fusible lipid-surfaced bodies (Fraley et al., Proc. Natl. Acad. Sci., USA, 79:1859 (1982));

protoplast transformation (EP 0 292 435); direct gene transfer (Paszkowski et al., EMBO J., 3:2717 (1984); Hayashimoto et al., Plant Physiol. 93:857 (1990)).

In still further embodiments, the vector may also be introduced into the plant cells by electroporation. (Fromm, et al., Pro. Natl Acad. Sci. USA 82:5824, 1985; Riggs et al., Proc. Natl. Acad. Sci. USA 83:5602 (1986)). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

In yet other embodiments, the vector is introduced through ballistic particle acceleration using devices (e.g., available from Agracetus, Inc., Madison, Wis. and Dupont, Inc., Wilmington, Del.). (See e.g., U.S. Pat. No. 4,945,050; and McCabe et al., Biotechnology 6:923 (1988)). See also, Weissinger et al., Annual Rev. Genet. 22:421 (1988); Sanford et al., Particulate Science and Technology, 5:27 (1987) (onion); Svab et al., Proc. Natl. Acad. Sci. USA, 87:8526 (1990) (tobacco chloroplast); Christou et al., Plant Physiol., 87:671 (1988) (soybean); McCabe et al., Bio/Technology 6:923 (1988) (soybean); Klein et al., Proc. Natl. Acad. Sci. USA, 85:4305 (1988) (maize); Klein et al., Bio/Technology, 6:559 (1988) (maize); Klein et al., Plant Physiol., 91:4404 (1988) (maize); Fromm et al., Bio/Technology, 8:833 (1990); and Gordon-Kamm et al., Plant Cell, 2:603 (1990) (maize); Koziel et al., Biotechnology, 11:194 (1993) (maize); Hill et al., Euphytica, 85:119 (1995) and Koziel et al., Annals of the New York Academy of Sciences 792:164 (1996); Shimamoto et al., Nature 338: 274 (1989) (rice); Christou et al., Biotechnology, 9:957 (1991) (rice); Datta et al., Bio/Technology 8:736 (1990) (rice); European Application EP 0 332 581 (orchardgrass and other Pooideae); Vasil et al., Biotechnology, 11: 1553 (1993) (wheat); Weeks et al., Plant Physiol., 102: 1077 (1993) (wheat); Wan et al., Plant Physiol. 104: 37 (1994) (barley); Jahne et al., Theor. Appl. Genet. 89:525 (1994) (barley); Knudsen and Muller, Planta, 185:330 (1991) (barley); Umbeck et al., Bio/Technology 5: 263 (1987) (cotton); Casas et al., Proc. Natl. Acad. Sci. USA 90:11212 (1993) (sorghum); Somers et al., Bio/Technology 10:1589 (1992) (oat); Torbert et al., Plant Cell Reports, 14:635 (1995) (oat); Weeks et al., Plant Physiol., 102:1077 (1993) (wheat); Chang et al., WO 94/13822 (wheat) and Nehra et al., The Plant Journal, 5:285 (1994) (wheat) herein incorporated by reference.

In addition to direct transformation, in some embodiments, the vectors comprising a nucleic acid sequence encoding an arginase or threonine deaminase gene are transferred using *Agrobacterium*-mediated transformation (Hinchee et al., Biotechnology, 6:915 (1988); Ishida et al., Nature Biotechnology 14:745 (1996), all of which are herein incorporated by reference). *Agrobacterium* is a representative genus of the gram-negative family Rhizobiaceae. Its species are responsible for plant tumors such as crown gall and hairy root disease. In the dedifferentiated tissue characteristic of the tumors, amino acid derivatives known as opines are produced and catabolized. The bacterial genes responsible for expression of opines are a convenient source of control elements for chimeric expression cassettes. Heterologous genetic sequences (e.g., nucleic acid sequences operatively linked to a promoter of the present invention), can be introduced into appropriate plant cells, by means of the Ti plasmid of *Agrobacterium tumefaciens*. The Ti plasmid is transmitted to plant cells on infection by *Agrobacterium tumefaciens*, and is stably integrated into the plant genome (Schell, Science, 237: 1176 (1987)). Species which are susceptible infection by *Agrobacterium* may be transformed in vitro.

4. Regeneration

After selecting for transformed plant material that can express a heterologous gene encoding an arginase or threonine deaminase gene or variant thereof, whole plants are regenerated. Plant regeneration from cultured protoplasts is described in Evans et al., Handbook of Plant Cell Cultures, Vol. 1: (MacMillan Publishing Co. New York, 1983); and Vasil I. R. (ed.), Cell Culture and Somatic Cell Genetics of Plants, Acad. Press, Orlando, Vol. I, 1984, and Vol. III, 1986, herein incorporated by reference. It is known that many plants can be regenerated from cultured cells or tissues, including but not limited to all major species of sugarcane, sugar beet, cotton, fruit and other trees, legumes and vegetables, and monocots (e.g., the plants described above). Means for regeneration vary from species to species of plants, but generally a suspension of transformed protoplasts containing copies of the heterologous gene is first provided. Callus tissue is formed and shoots may be induced from callus and subsequently rooted.

Alternatively, embryo formation can be induced from the protoplast suspension. These embryos germinate and form mature plants. The culture media will generally contain various amino acids and hormones, such as auxin and cytokinins. Shoots and roots normally develop simultaneously. Efficient regeneration will depend on the medium, on the genotype, and on the history of the culture. The reproducibility of regeneration depends on the control of these variables.

5. Generation of Transgenic Lines

Transgenic lines are established from transgenic plants by tissue culture propagation. The presence of nucleic acid sequences encoding an exogenous arginase or threonine deaminase gene or mutants or variants thereof may be transferred to related varieties by traditional plant breeding techniques. Examples of transgenic lines are described herein and in Example 1. These transgenic lines are then utilized for evaluation of guanidino substrate hydrolysis activity, insect resistance ratios, phenotype, pathogen resistance and other agronomic traits.

The transgenic plants and lines are tested for the effects of the transgene on one or more of an insect resistance phenotype, a microorganism resistance phenotype, a bacterial resistance phenotype, a microorganism interation phenotype, an insect killing phenotype. The parameters evaluated for insect resistance are compared to those in control untransformed plants and lines. Parameters evaluated include rates of guanidino substrate hydrolysis activity, effects of light, heat, cold; effects on altering steady-state ratios and effects on guanidino substrate hydrolysis activity. Rates of guanidino substrate hydrolysis activity can be expressed as a unit of time, as Km, at certain pH levels, or in a particular tissue or as a developmental state; for example, guanidino substrate hydrolysis activity *Lycopersicon esculentum* can be measured in leaves. These tests are conducted both in the greenhouse and in the field. The terms "altered insect resistance ratios" and "altering guanidino substrate hydrolysis activity" refers to any changes in guanidino substrate hydrolysis activity.

The present invention also provides any of the isolated nucleic acid sequences described above operably linked to a promoter. In some embodiments, the promoter is a heterologous promoter. In other embodiments, the promoter is a plant promoter. The present invention also provides a vector comprising any of the nucleic acid sequences described above. In some embodiments, the vector is a cloning vector; in other embodiments, the vector is an expression vector. In some further embodiments, the nucleic acid sequence in the vector is linked to a promoter. In some further embodiments, the promoter is a heterologous promoter. In other further embodiments, the promoter is a plant promoter.

The present invention also provides a transgenic host cell comprising any of the nucleic acid sequences of the present invention described above, wherein the nucleic acid sequence is heterologous to the host cell. In some embodiments, the nucleic acid sequence is operably linked to any of the promoters described above. In other embodiments, the nucleic acid is present in any of the vectors described above.

The present invention also provides a transgenic organism comprising any of the nucleic acid sequences of the present invention described above, wherein the nucleic acid sequence is heterologous to the organism. In some embodiments, the nucleic acid sequence is operably linked to any of the promoters described above. In other embodiments, the nucleic acid is present in any of the vectors described above.

The present invention also provides a transgenic plant, a transgenic plant part, a transgenic plant cell, or a transgenic plant seed, comprising any of the nucleic acid sequences of the present invention described above, wherein the nucleic acid sequence is heterologous to the transgenic plant, a transgenic plant part, a transgenic plant cell, or a transgenic plant seed. In some embodiments, the nucleic acid sequence is operably linked to any of the promoters described above. In other embodiments, the nucleic acid is present in any of the vectors described above.

The present invention also provides a method for producing an arginase or threonine deaminase polypeptide, comprising culturing a transgenic host cell comprising a heterologous nucleic acid sequence, wherein the heterologous nucleic acid sequence is any of the nucleic acid sequences of the present invention described above which encode an arginase or threonine deaminase polypeptide or variant thereof, under conditions sufficient for expression of the encoded arginase or threonine deaminase polypeptide, and producing the arginase or threonine deaminase polypeptide in the transgenic host cell. In some embodiments, the nucleic acid sequence is operably linked to any of the promoters described above. In other embodiments, the nucleic acid is present in any of the vectors described above. The present invention also provides a method for producing an arginase or threonine deaminase polypeptide, comprising growing a transgenic host cell comprising a heterologous nucleic acid sequence, wherein the heterologous nucleic acid sequence is any of the nucleic acid sequences of the present invention described above encoding an arginase or threonine deaminase polypeptide or a variant thereof, under conditions sufficient for expression of the encoded arginase or threonine deaminase polypeptide, and producing the arginase or threonine deaminase polypeptide in the transgenic host cell.

The present invention also provides a method for altering the phenotype of a plant, comprising providing an expression vector comprising any of the nucleic acid sequences of the present invention described above, and plant tissue, and transfecting the plant tissue with the vector under conditions such that a plant is obtained from the transfected tissue and the nucleic acid sequence is expressed in the plant and the phenotype of the plant is altered. In some embodiments, the nucleic acid sequence encodes an arginase or threonine deaminase polypeptide or variant thereof. In other embodiments, the nucleic sequence encodes a nucleic acid product which interferes with the expression of a nucleic acid sequence encoding an arginase or threonine deaminase polypeptide or variant thereof, wherein the interference is based upon the coding sequence of the arginase or threonine deaminase protein or variant thereof. In some embodiments, the nucleic acid sequence is operably linked to any of the promoters described above. In other embodiments, the nucleic acid is present in any of the vectors described above.

The present invention also provides a method for altering the phenotype of a plant, comprising growing a transgenic plant comprising an expression vector comprising any of the nucleic acid sequences of the present invention described above under conditions such that the nucleic acid sequence is expressed and the phenotype of the plant is altered. In some embodiments, the nucleic acid sequence encodes an arginase or threonine deaminase polypeptide or variant thereof. In other embodiments, the nucleic sequence encodes a nucleic acid product which interferes with the expression of a nucleic acid sequence encoding an arginase or threonine deaminase polypeptide or variant thereof, wherein the interference is based upon the coding sequence of the arginase or threonine deaminase protein or variant thereof. In some embodiments, the nucleic acid sequence is operably linked to any of the promoters described above. In other embodiments, the nucleic acid is present in any of the vectors described above.

EXPERIMENTAL

The following examples serve to illustrate certain embodiments and aspects of the present invention and are not to be construed as liming the scope thereof. In the experimental disclosures which follow, the following abbreviations apply: N (normal); M (molar); mM (millimolar); µM (micromolar); mol (moles); mmol (millimoles); µmol (micromoles); nmol (nanomoles); pmol (picomoles); g (grams); mg (milligrams); µg (micrograms); ng (nanograms); pg (picograms); L or l (liters); ml (milliliters); µl (microliters); cm (centimeters); mm (millimeters); µm (micrometers); nm (nanometers); ° C. (degrees Centigrade).

The following is a description of exemplary materials and methods that were used in subsequent Examples.

Example 1

Materials and Methods

Plant Material and Treatments—Tomato (*Lycopersicon esculentum* cv. Castlemart) plants were grown in Jiffy peat pots (Hummert International) in a growth chamber maintained under 17 h of light (200 µE m$^{-2}$ s$^{-1}$) at 28° C. and 7 h of dark at 18° C. Seed for the sterile jail-1 mutant was obtained from a segregating population as described by Li et al. (Li et al., *Plant Physiol:* 127:1414-1417 (2001)). Flowers and fruits were harvested from plants maintained in a greenhouse. For experiments involving MeJA treatment, forty three-week-old plants were placed in a closed Lucite box (31 cm×27 cm×14 cm) and treated with 2 µl of pure MeJA (Bedoukian Research) dissolved in 300 µl of ethanol, as previously described (Li et al., *Plant Mol. Biol.* 46:409-419 (2001)). A hemostat was used to inflict mechanical wounds near the distal end of leaflet, perpendicular to the midvein. Zhao et al. (Zhao et al., *Plant J.* 36:485-499 (2003)) described the source of coronatine (COR) and application to tomato plants. Briefly, 20 ng of COR (dissolved in 0.1 M NH$_4$HCO$_3$, 5 ng/µl) was applied to the adaxial surface of leaflets of three-week-old tomato plants. Control plants were treated with 4 µl of 0.1 M NH$_4$HCO$_3$. The sources and growth conditions of *Pseudomonas syringae* pv. tomato strain DC3000 (Pst DC3000) and the mutant strain Pst DC3118 COR$^-$ were described previously (Zhao et al., *Plant J.* 36:485-499 (2003)). Bacterial suspensions were vacuum-infiltrated into the leaves of three-week-old plants (Zhao et al., Plant J.

36:485-499 (2003)). Three replicate samples were taken for each treatment over a four-day period. At various times following the treatment, leaf tissue was harvested, frozen in liquid nitrogen, and stored at −80° C. until further use for RNA extraction assays (see below).

Identification of Full-Length LeARG cDNAs—

A search of the tomato EST (Expressed Sequence Tag) database (version 9.0 released on Apr. 17, 2003) at the Institute for Genomic Research (tigr.org/tdb/lgi/) identified two tentative consensus sequences (TC124738 and TC124737, herein incorporated by reference) that were annotated as arginase. cDNA clones (EST435583 and EST337938, herein incorporated by reference) corresponding to representative members of these two genes were obtained from the Clemson University Genomics Institute. cDNA inserts from each clone were sequenced in their entirety on both strands. The cDNA corresponding to EST435583, herein incorporated by reference, which we designated LeARG1, was 1508 base pairs (bp) in length and included 252 bp upstream of the initiator AUG codon and 209 bp in the 3'-untranslated region (excluding 30 poly(A) residues). The presence of an in-frame stop codon (TAA) nine nucleotides upstream of the initiator AUG codon indicated that the cDNA encodes a full-length protein. The cDNA corresponding to EST337938 herein incorporated by reference, which we designated LeARG2, was 1360 bp in length and included 19 bp upstream of the initiator AUG codon and 266 bp in the 3'-untranslated region (excluding 58 poly(A) residues) SEQ ID NO:01. The presence of an in-frame stop codon (TAA) 9 nucleotides upstream of the initiator AUG codon indicated that this cDNA also encodes a full-length protein. Database searches were performed using the BLAST program (Altschul et al., *J. Mol. Biol.* 215:403-410(1990)) available at the U.S. National Center for Biotechnology.

Arginase Phylogeny—

Figure 9A1:
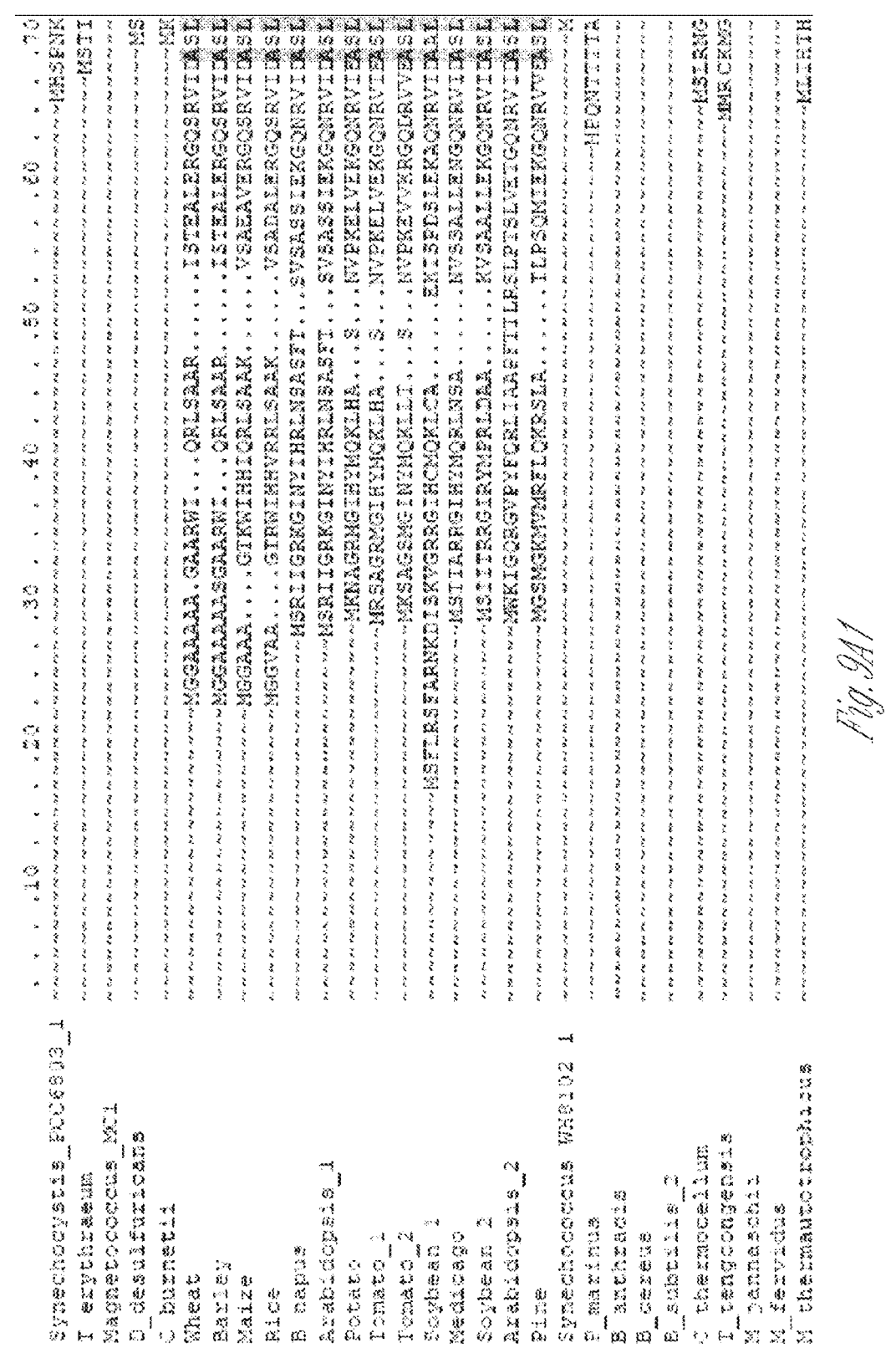
Figure 9A2:
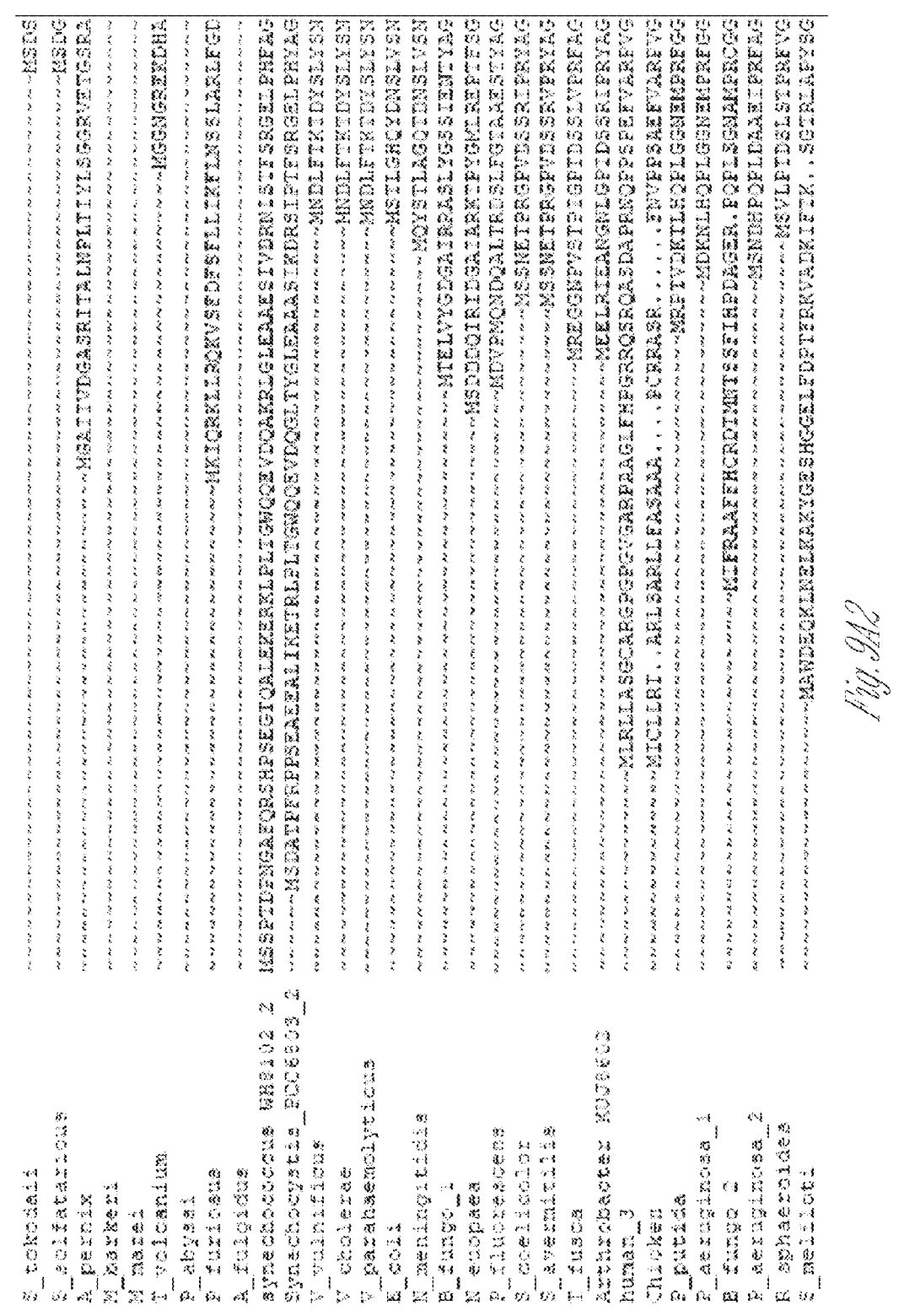
Figure 9B1:
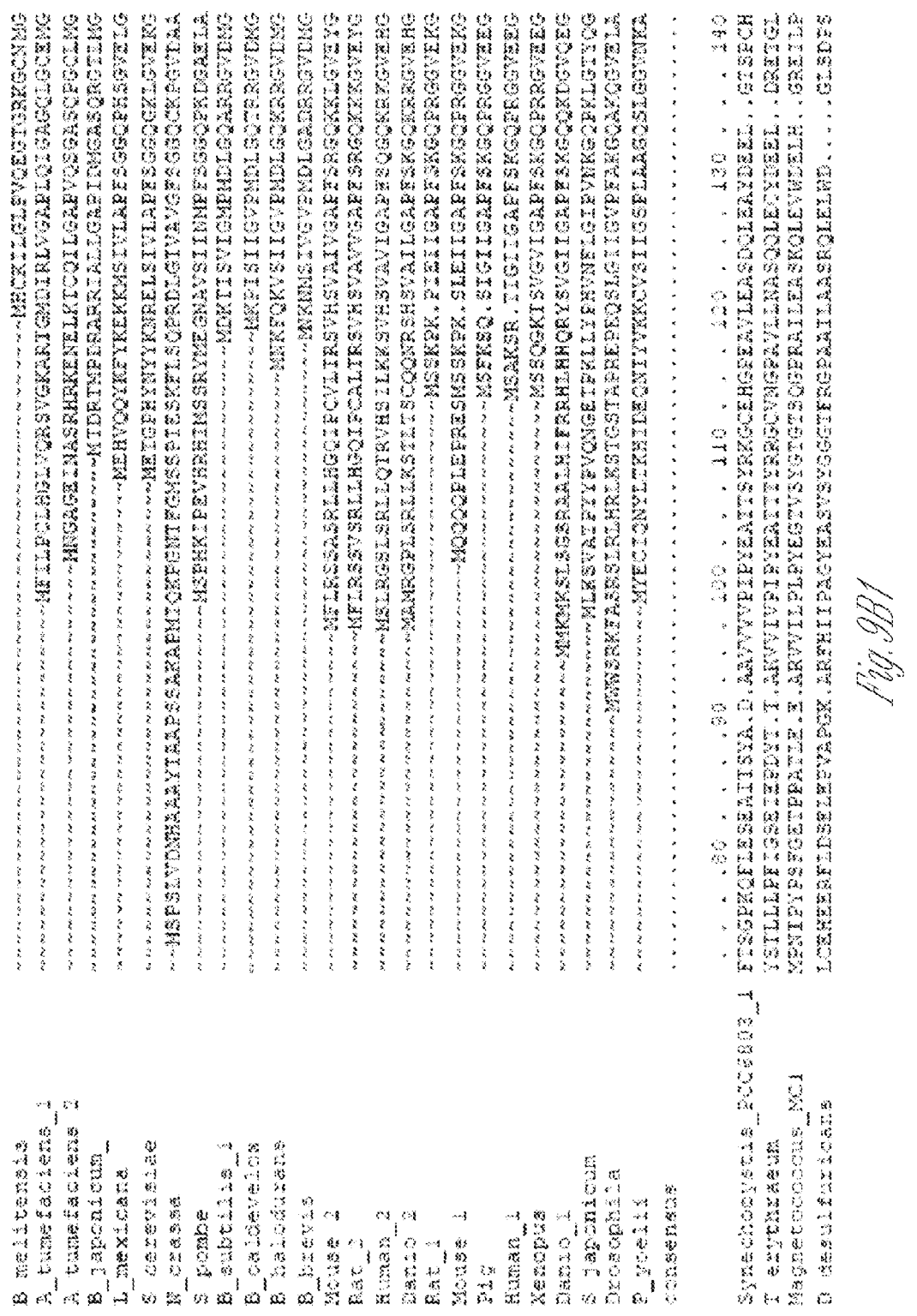
Figure 9B2:
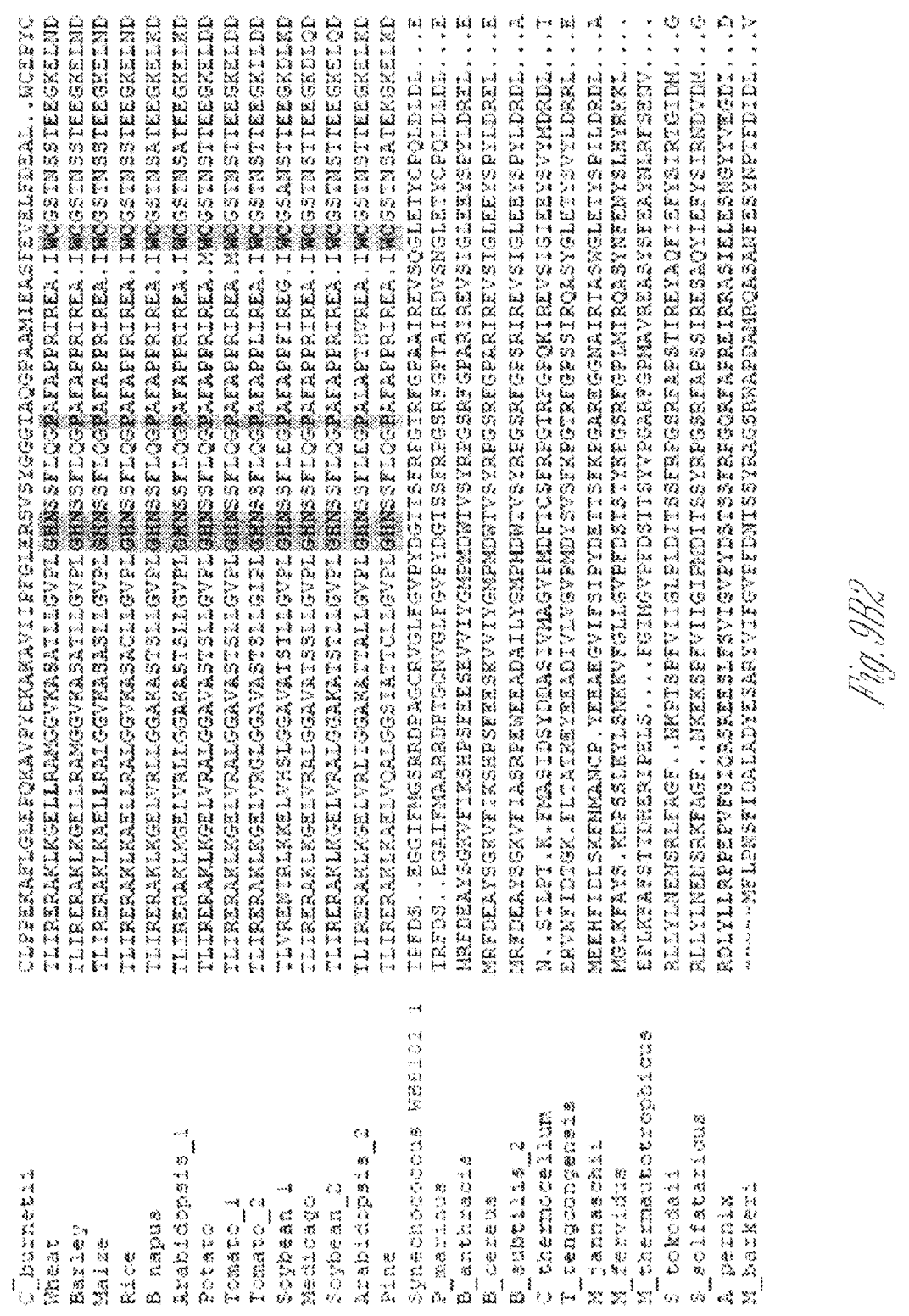
Figure 9C2:
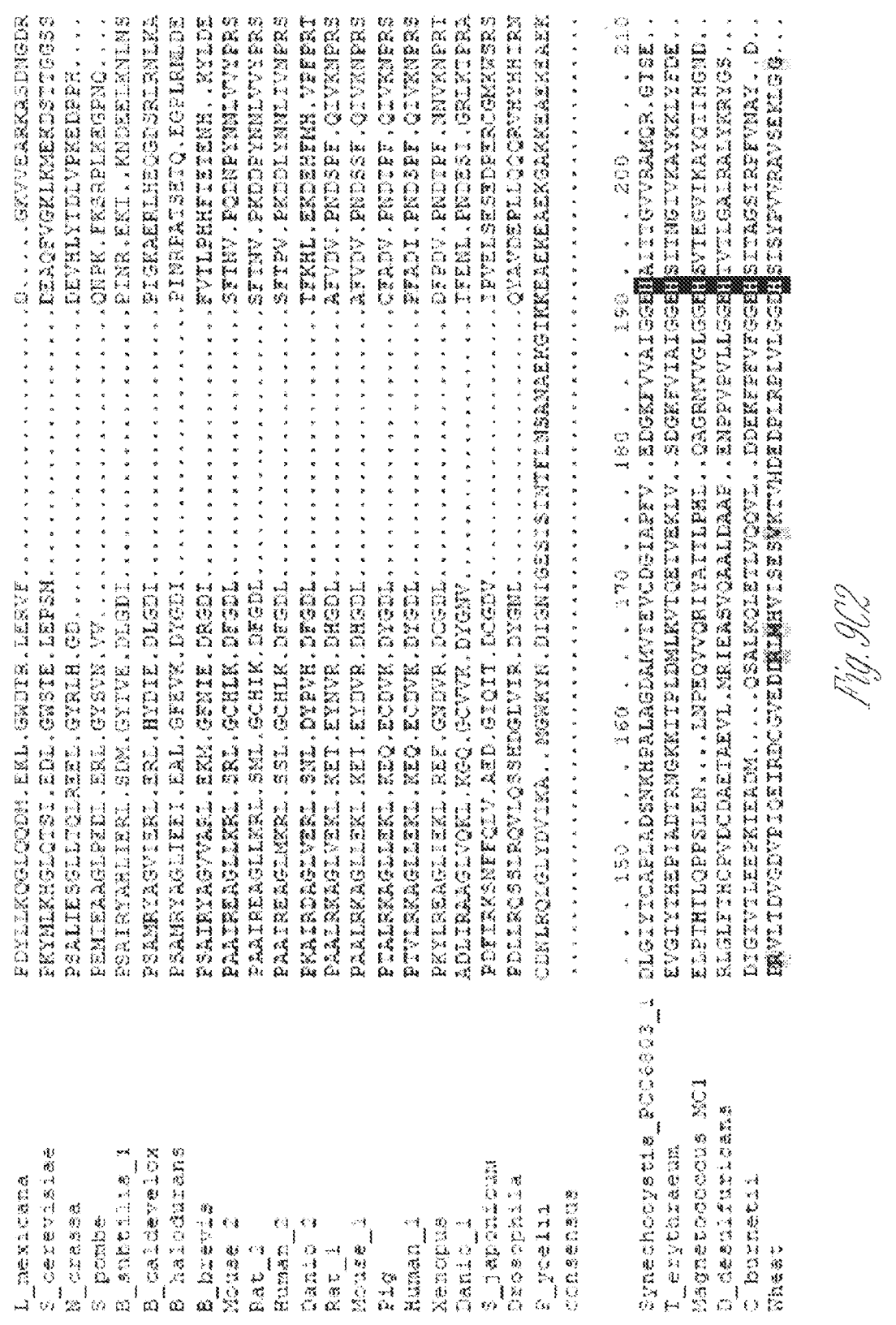
Figure 9D1:
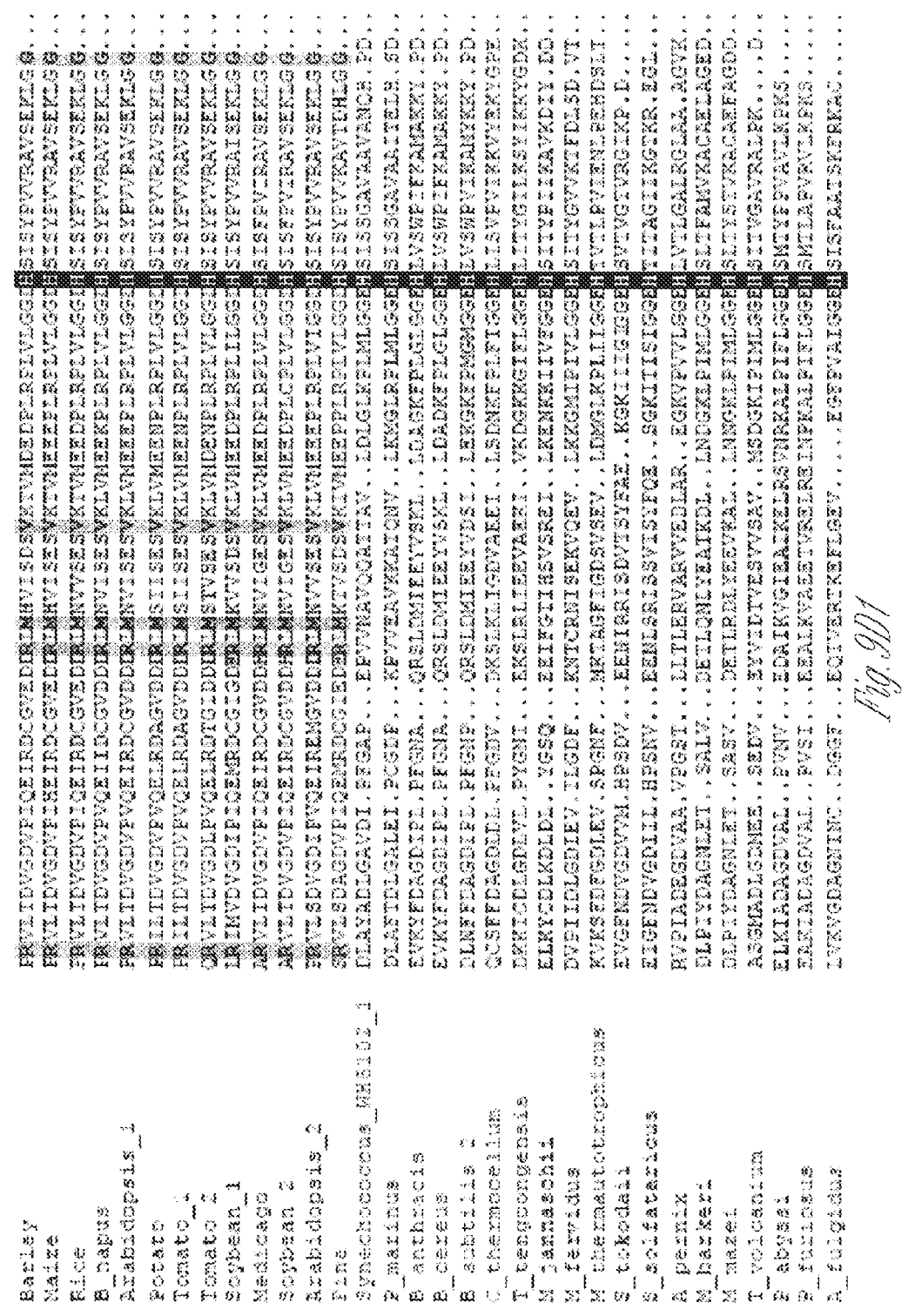
Figure 9D2:
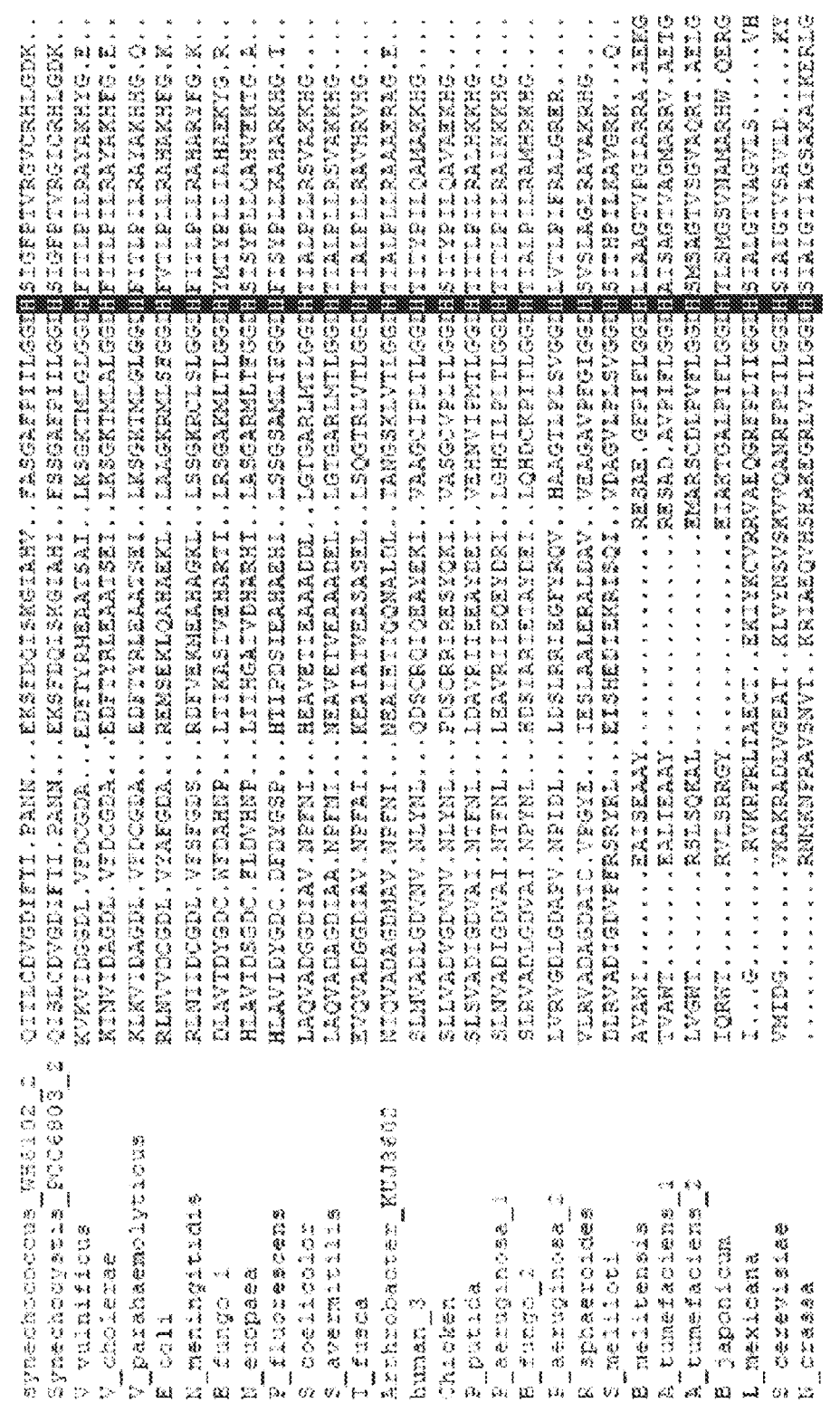
Figure 9D1:
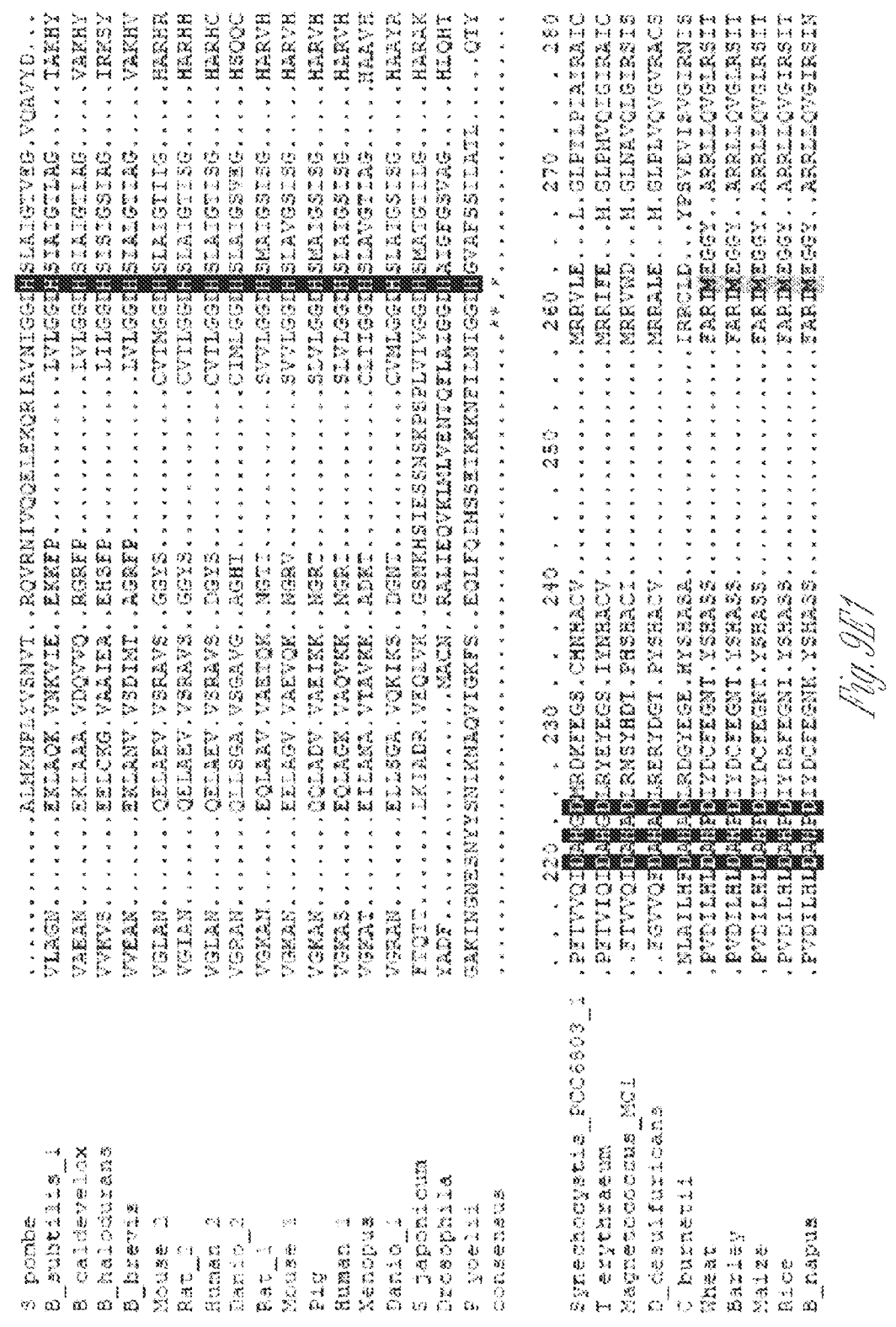
Figure 9E2:
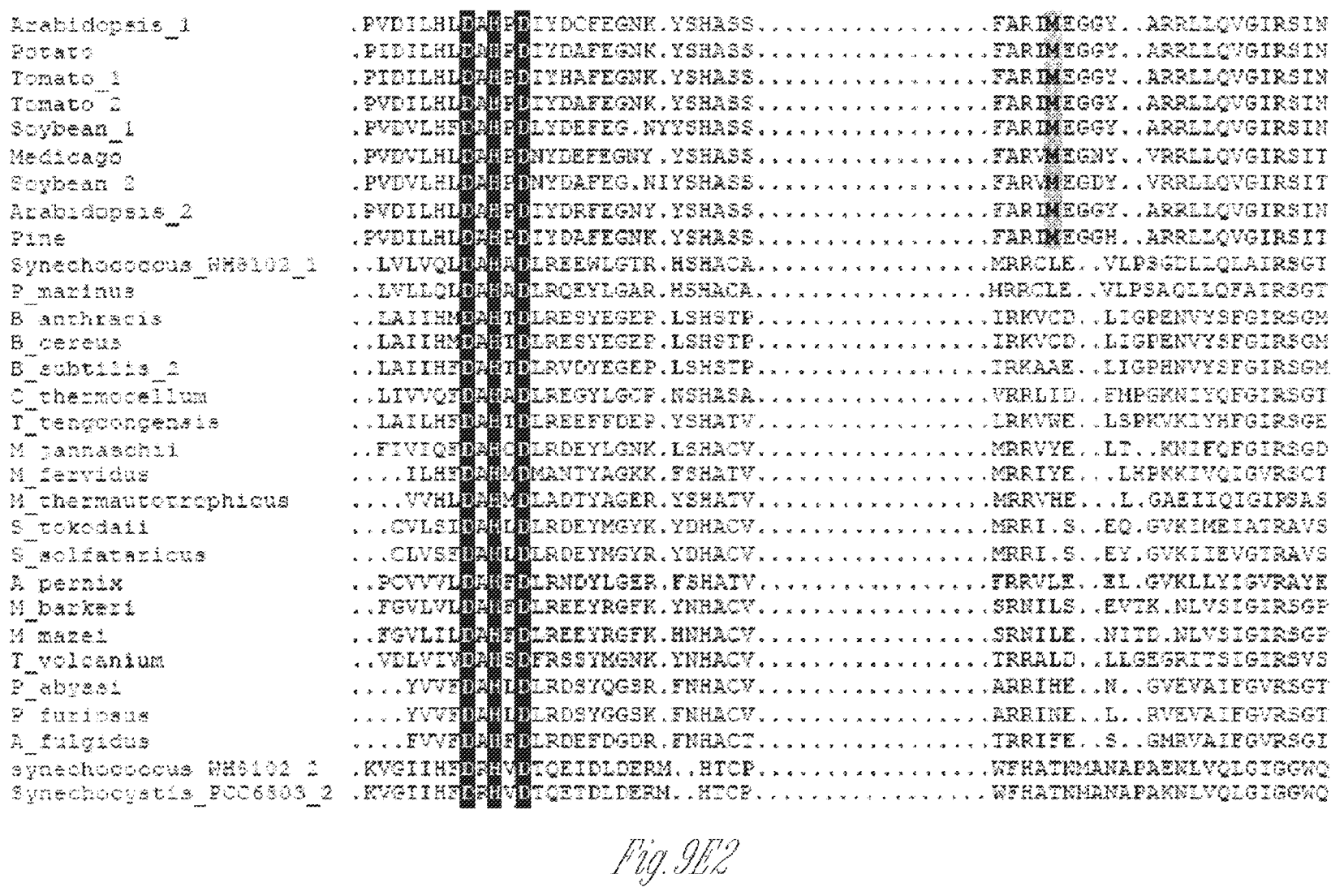
Figure 9A:
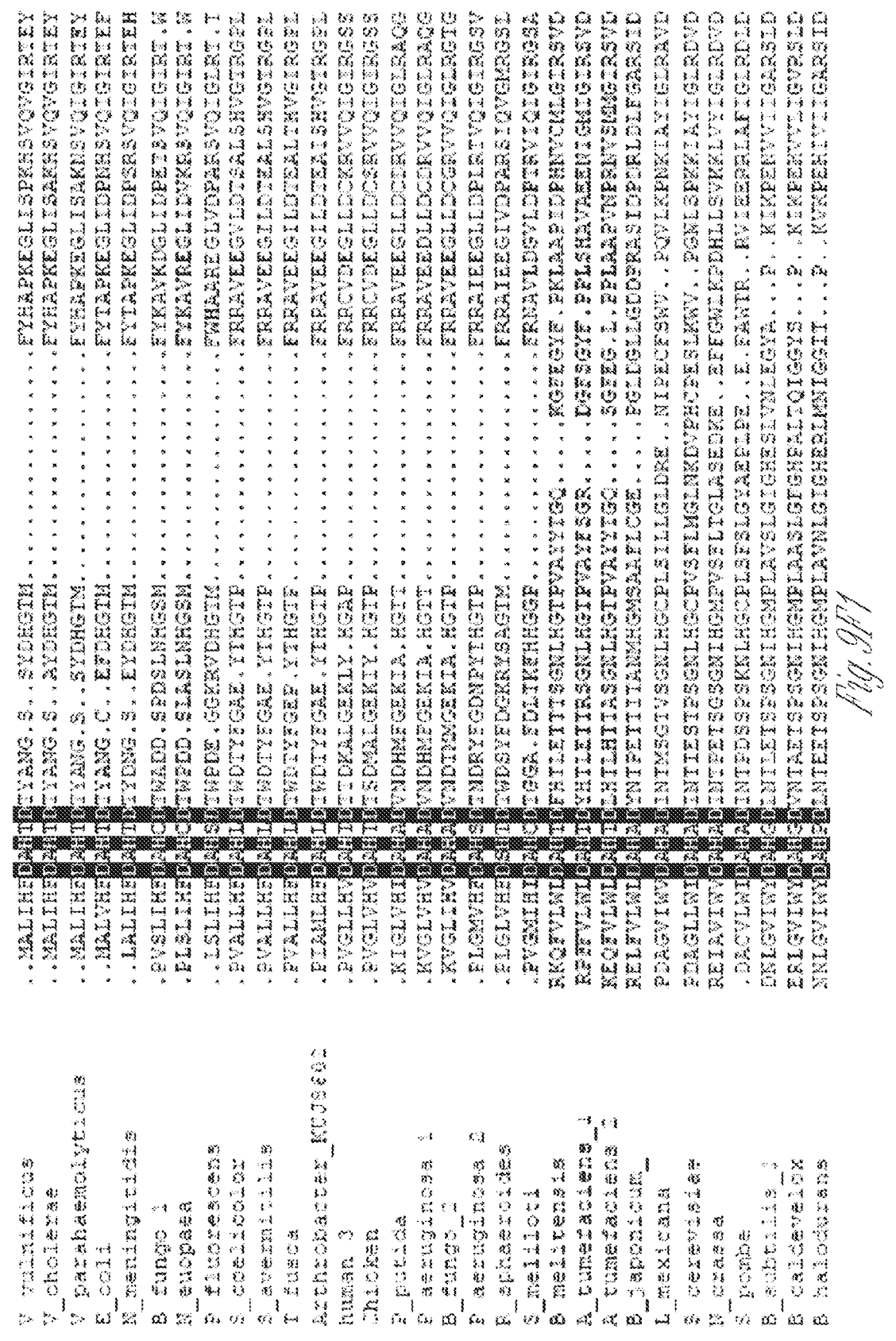
Figure 9A:
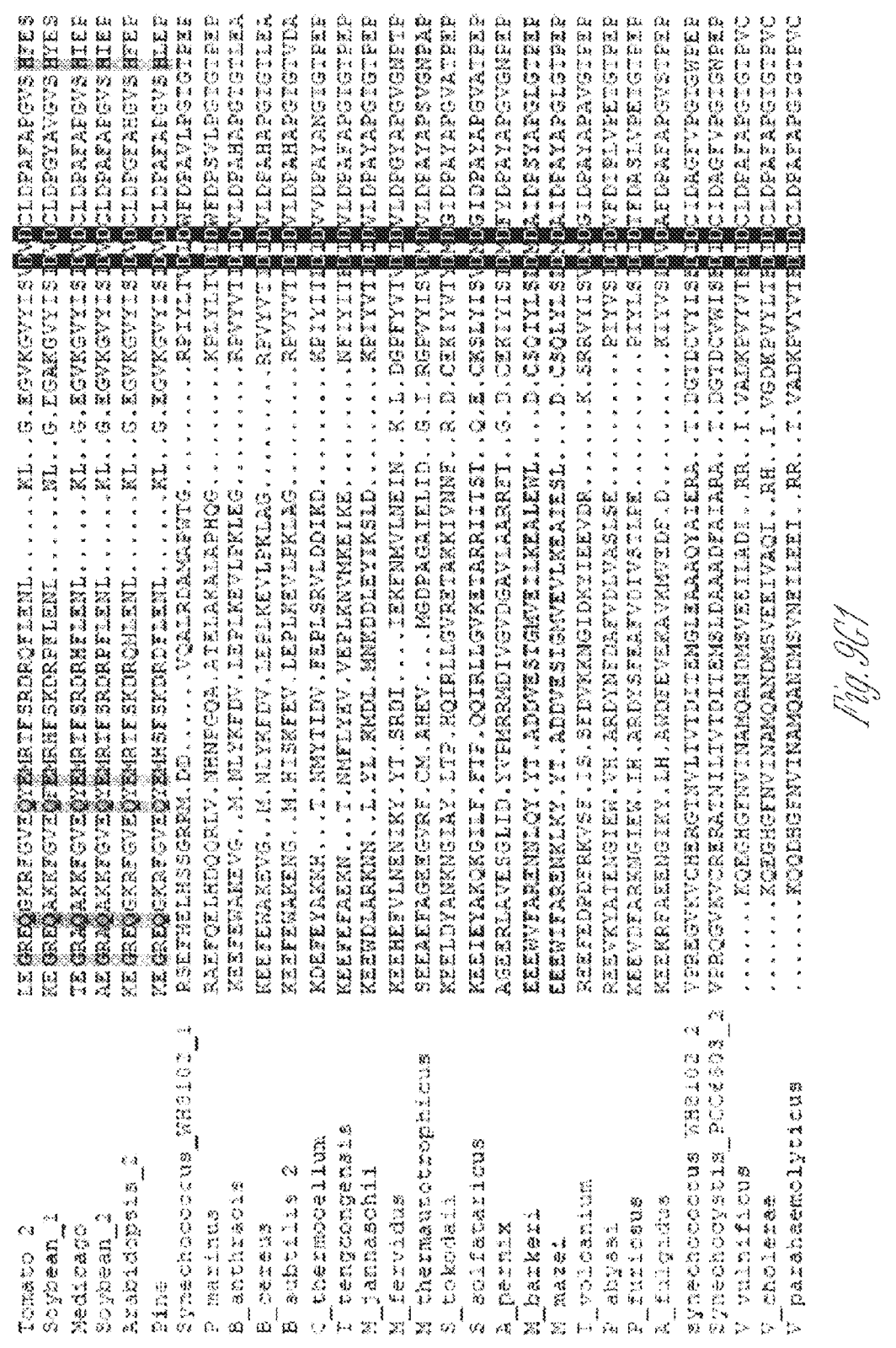
Figure 9H:
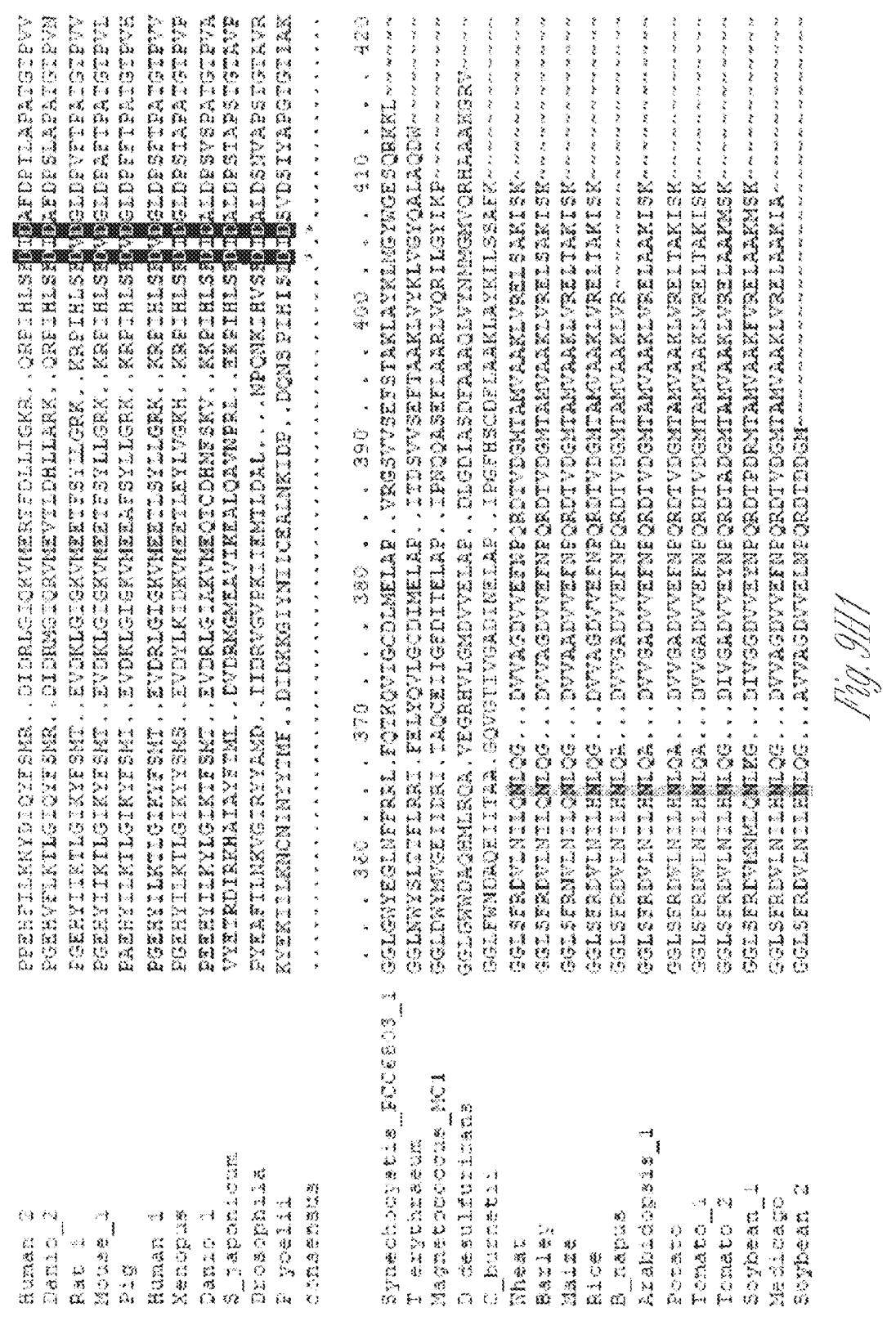
Figure 9H2:
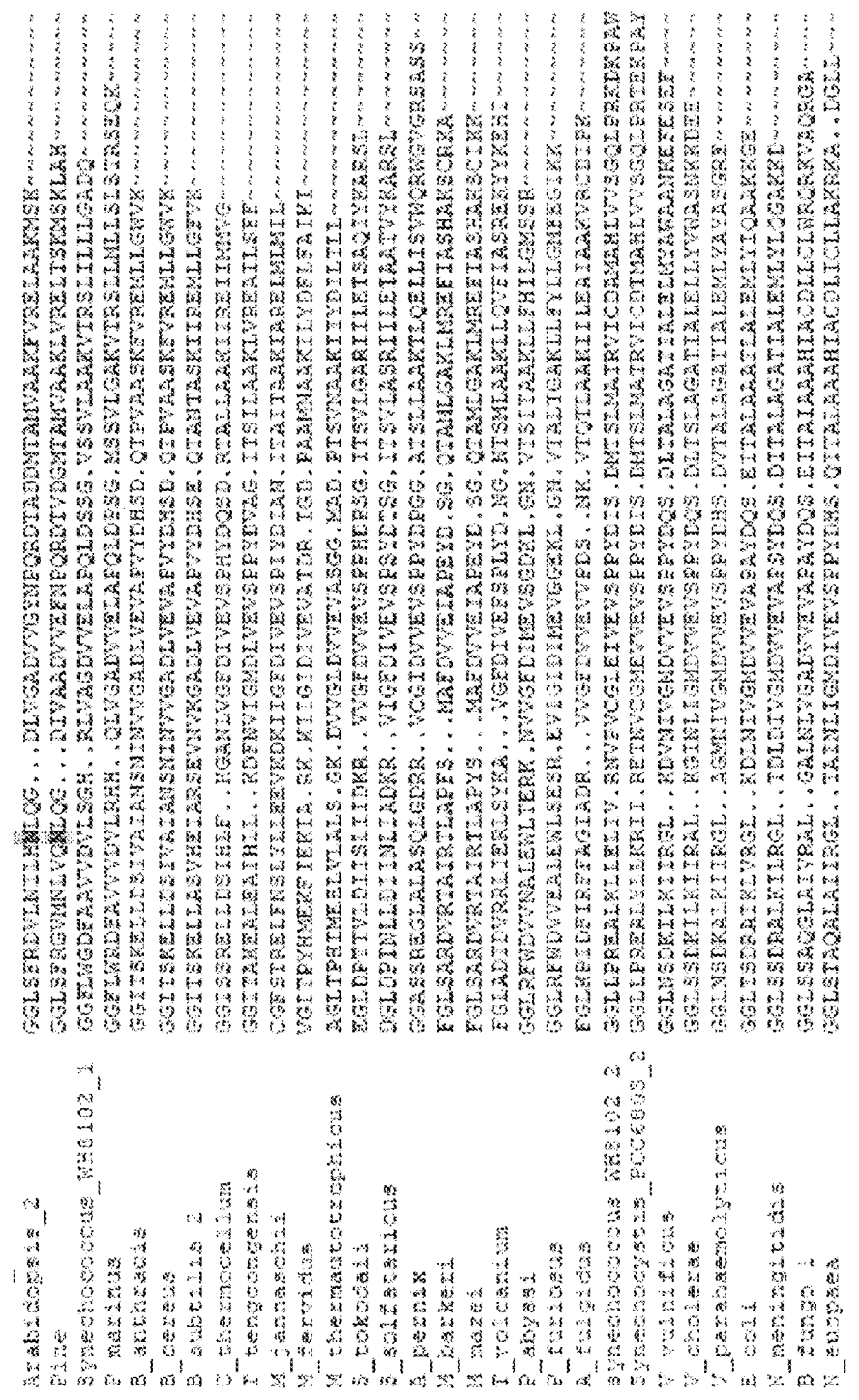
Figure 9H:
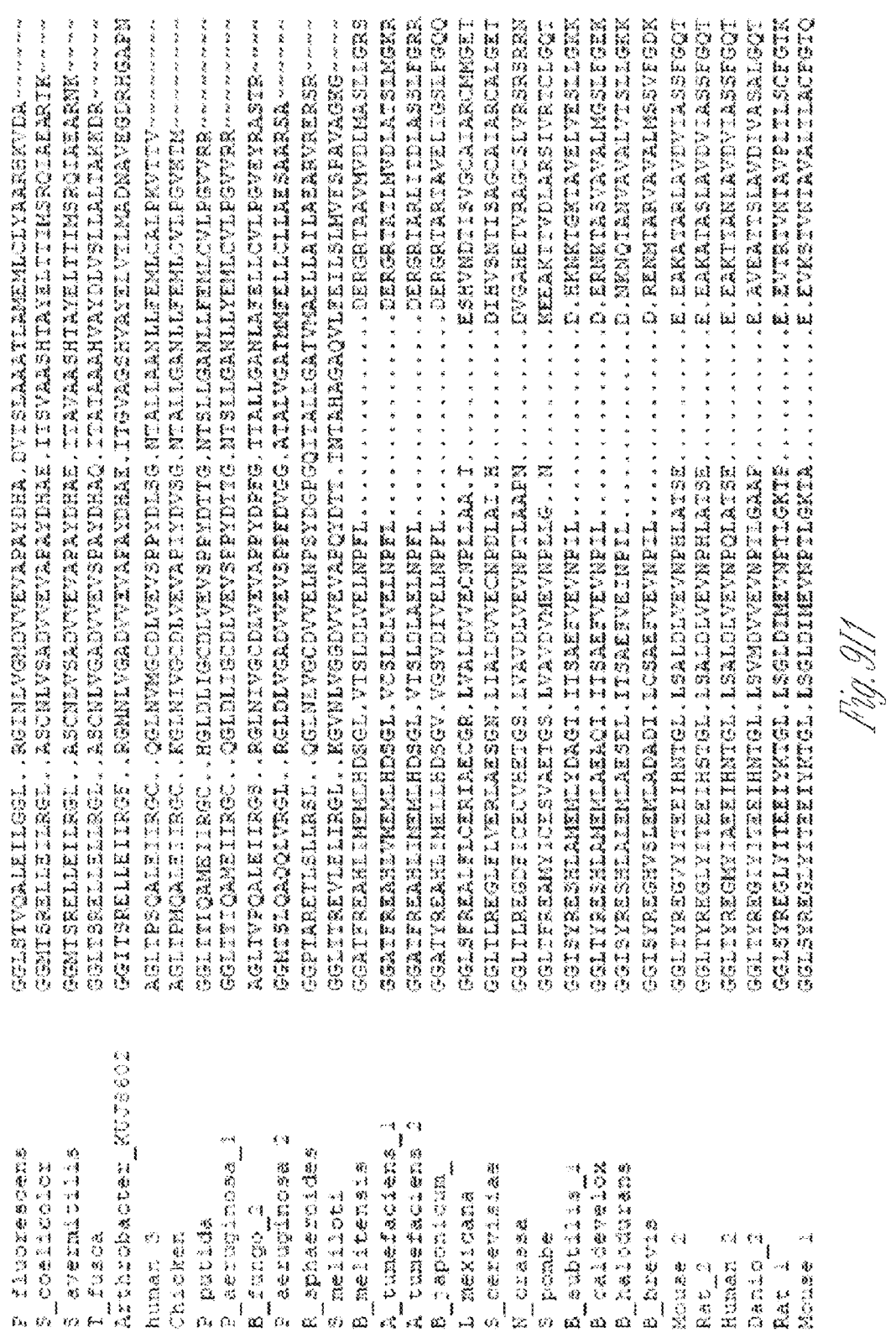
Figure 9I2:
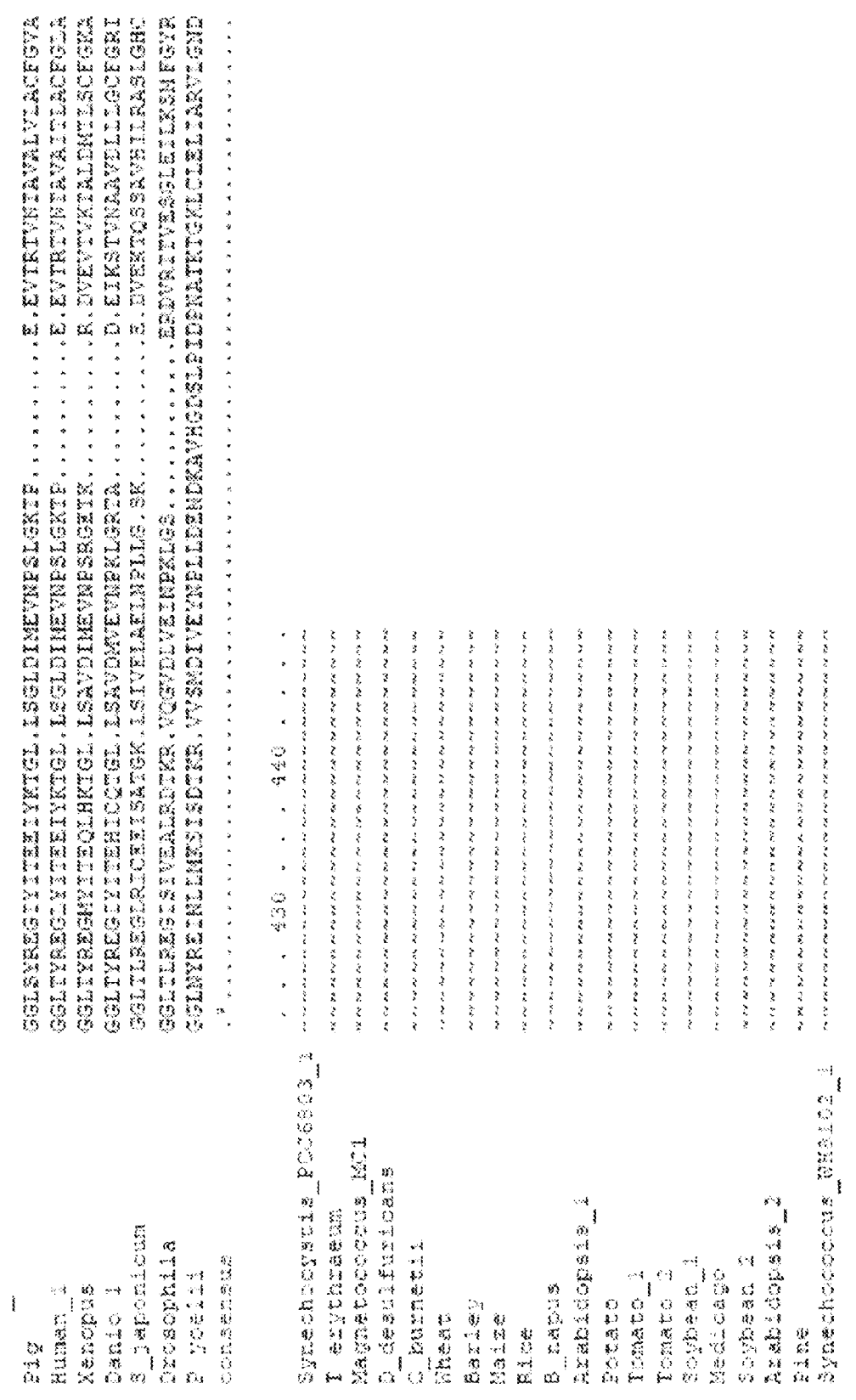
Figure 1:
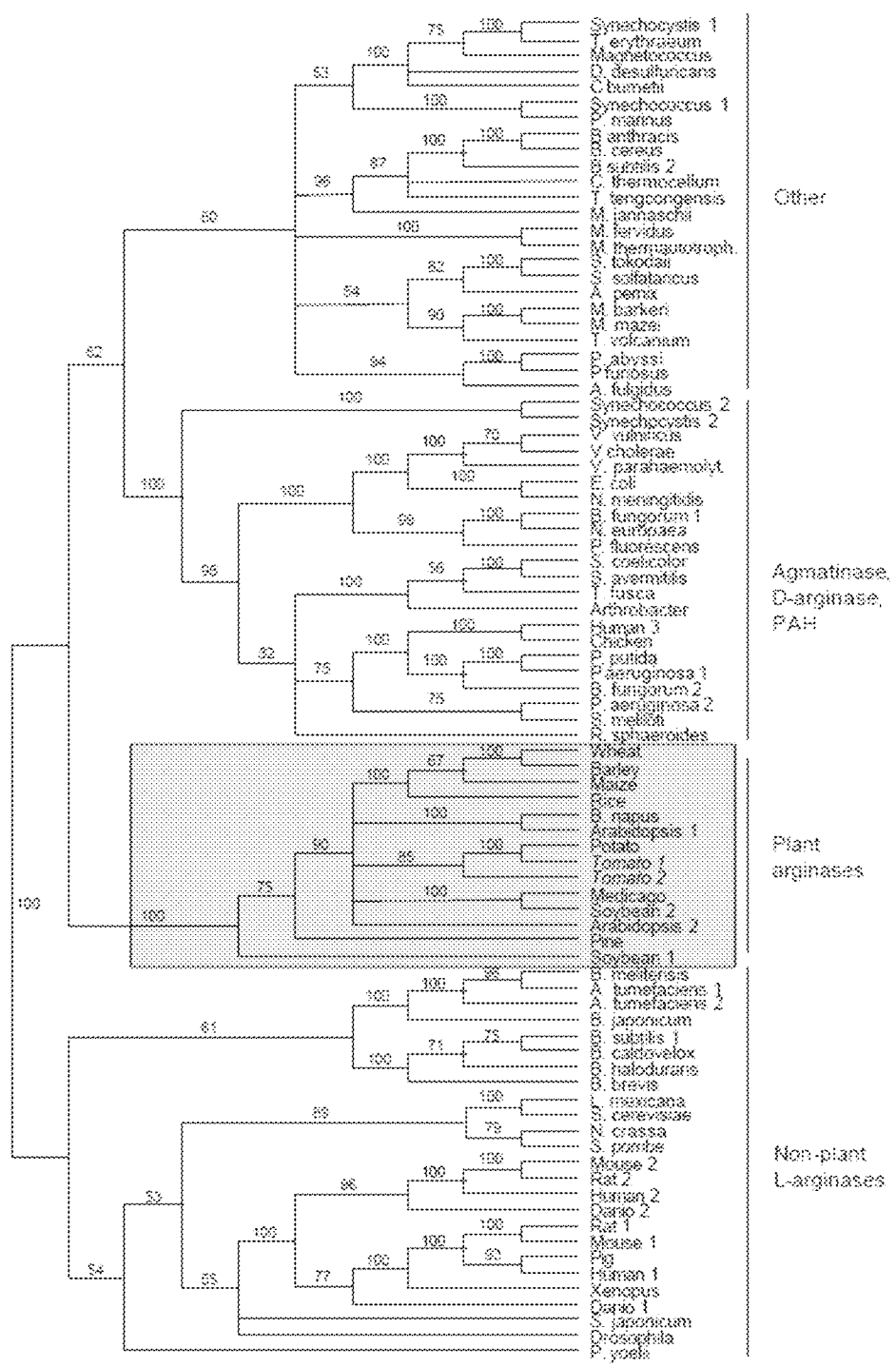
FIG. 1 shows an exemplary embodiment that demonstrates a phylogenetic tree of the arginase superfamily. A mid-point rooted neighbor-joining phylogeny was constructed with 85 amidinohydrolase sequences from diverse organisms. Neighbor-joining bootstrap replicates were run to test the branching order reliability. Accession numbers are listed in the legend to FIG. 9. The four major sub-groups of the phylogeny are indicated on the right, with plant arginases in the shaded box. PAH, proclavaminate amidino hydrolase.
Figure 3:
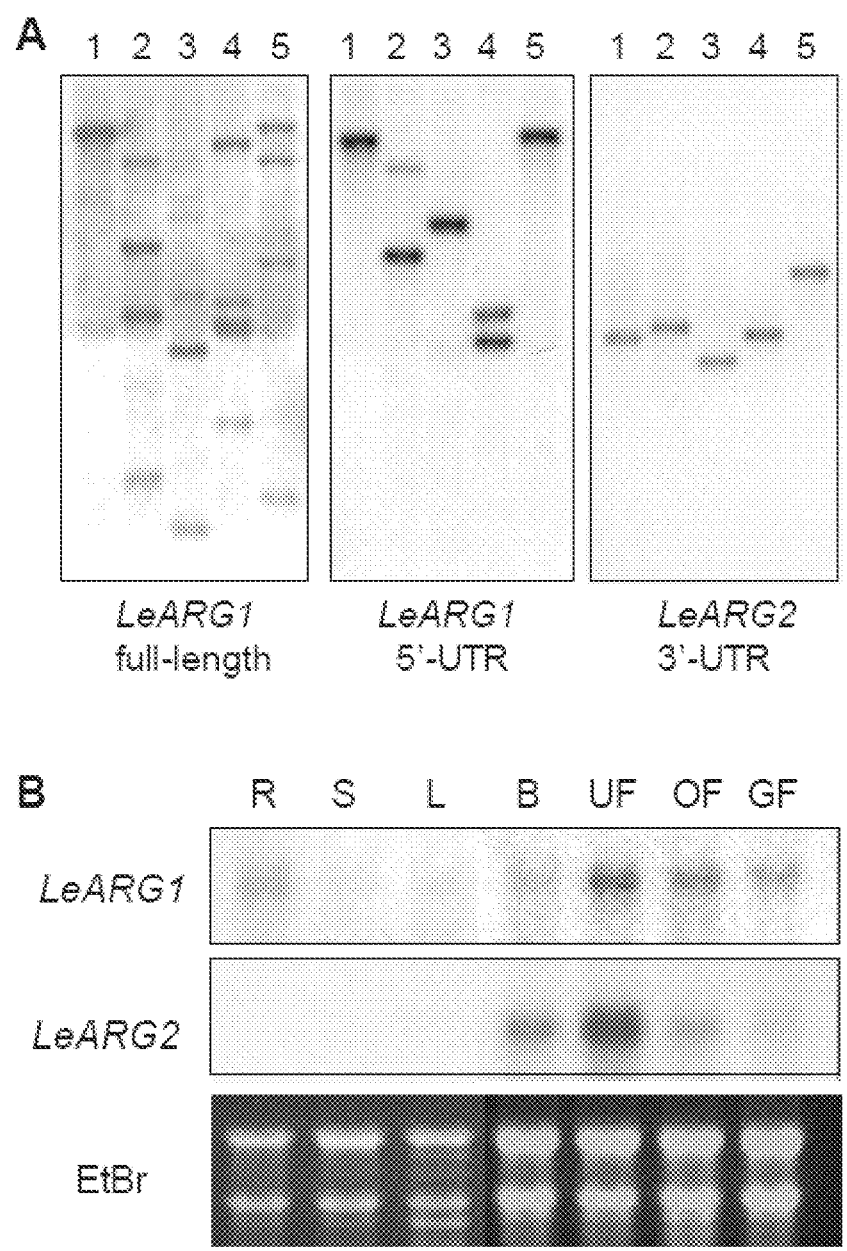
FIG. 3 shows an exemplary embodiment that demonstrates a tissue-specific expression of LeARG1 and LeARG2. A, Genomic DNA blot analysis of LeARG1 and LeARG2. Genomic DNA from tomato was digested with restriction enzymes BamHI (lane 1), EcoRI (lane 2), EcoRV (lane 3), HindIII (lane 4), or XbaI (lane 5), separated by agarose-gel electrophoresis, and transferred to Hybond-N Plus membranes by capillary blotting. DNA blots were hybridized to $^{32}$P-labeled probes corresponding to the full-length LeARG1 cDNA (left panel), or to gene-specific probes that recognize the 5'-untranslated region of LeARG1 (middle panel) or the 3'-untranslated region of LeARG2 (right panel). B, Accumulation of LeARG1 and LeARG2 transcripts in various tissues. Total RNA was extracted from roots (R), stems (S), and leaves (L) of 3-week-old plants, and from developing flower buds (B), mature unopened flowers (IF), mature opened flowers (OF), and small (<0.5 cm) immature green fruit (GF). RNA blots were hybridized to $^{32}$P-labeled gene-specific probes for LeARG1 and LeARG2. As a control for equal loading of RNA, a duplicate gel containing the RNA samples was stained with ethidium bromide (EtBr).

Members of the arginase superfamily were identified by BLAST searches against non-redundant sequence databases (ncbi.nlm.nih.gov/BLAST/) and TIGR plant EST databases (tigr.org/tdb/tgi/plant.shtml) all of which are herein incorporated by reference. Sequences obtained from the TIGR databases are composed of unigene 10 clusters of multiple EST clones. A total of 85 sequences, see, FIG. 9, were used for construction of the phylogenetic tree (FIG. 1). Sequence accession numbers are listed in FIG. 9. Amino acid sequences were aligned using PILEUP in the GCG software suite (Wisconsin Package version 10.2, Genetics Computer Group (GCG), Madison, Wis.). A neighbor joining phylogeny was constructed from mean character distances using PAUP 4.0*, version 4.0b10 (PPC) (Swofford et al., *PAUP*. Phylogenetic Analysis Using Parsimony (*and Other Methods)*, Version 4. Sinauer Associates, Sunderland, Mass. (2000)), herein incorporated by reference. Neighbor-joining bootstrap replicates were run to test the branching order reliability.

Expression and Purification of Recombinant LeARG1 and LeARG2—

Basic molecular techniques were performed as described in Sambrook et al. (Sambrook et al., Molecular Cloning: A Laboratory Manual, $2^{nd}$ Ed., Cold Springer Harbor Laboratory, Cold Spring Harbor, N.Y. (1989)), herein incorporated by reference. A PCR-based approach was used to construct the expression vector that added a C-terminal $His_6$ tag to the LeARG coding sequence. Forward and reverse primers were designed to contain NdeI and XhoI restriction sites, respectively. For preparation of the LeARG1 construct, the sequence of the forward primer was 5'-GGA ATT CCA TAT GAG GAG TGC TGG AAG AAT-3' SEQ ID NO:114 and that of the reverse primer was 5'-CCG CTC GAG CTT GGA TAT CTT GGC AGT AAG-3' SEQ ID NO:115. For preparation of the LeARG2 construct, the sequence of the forward primer was 5'-GGA ATT CCA TAT GAA GAG TGC TGG AAG TAT-3' SEQ ID NO:116 and that of the reverse primer was 5'-CCG CTC GAG CTT GGA CAT CTT GGC AGC AAG-3' SEQ ID NO:117. PCR amplification of EST435583, herein incorporated by reference, (LeARG1) and EST337938, herein incorporated by reference, (LeARG2) yielded a 1.0-kilobase product, SEQ ID NO:131, that was subsequently cut with NdeI and XhoI subcloned into the same sites of the expression vector pET-23b (Novagen, Madison, Wis.). The resulting construct placed an additional eight amino acids (LEHHHHH SEQ ID NO:118) on the C terminus of the protein. His-tagged recombinant proteins were expressed in BL23 (DE3) host cells as follows. An overnight culture (1 ml) was inoculated into 50 ml Terrific Broth medium supplemented with 200 µg/ml ampicillin. Bacteria were grown at 37° C. in a shaker at 250 rpm for 4 h to a cell density of about 1.2 $OD_{600}$, and then isopropyl-thio-β-D-galactopyranoside (IPTG) was added to a final concentration of 0.25 mM. The induced culture was incubated for 4 h at 37° C. Cells were collected by centrifugation and stored at −20° C. until further use.

Purification of the His-tagged LeARG1 and LeARG2 was performed at 4° C. except where otherwise noted. Bacterial cells expressing the construct were harvested from 50 ml of culture medium, followed by resuspension in 2 ml of Tris buffer (50 mM, pH 8.0) containing 0.1 mM phenylmethyl sulfonyl fluoride (PMSF). Cells were first incubated with 2.5 mg lysozyme for 60 min at room temperature and then lysed using three 2-min pulses from a probe-type sonicator (Branson Sonifier Model 450). Cell homogenates were centrifuged at 20,000×g for 10 min. The resulting supernatant was collected and the buffer was exchanged to binding buffer (5 mM imidazole, 500 mM NaCl, 20 mM Tris-HCl, pH 7.9) with a 5-ml spin column prepared with Sephadex G-25 (Amersham Biosciences) and equilibrated with binding buffer. Nickel-charged resin columns having a 1-ml bed volume (QIAGEN Inc., USA) were conditioned with 10 ml of water and then 5 ml of binding buffer. After loading the protein solution (2 ml in binding buffer), the column was washed with 10 ml of binding buffer and 10 ml of washing buffer (80 mM imidazole, 500 mM NaCl, 20 mM Tris-HCl, pH 7.9). His-tagged arginase was eluted with elution buffer (400 mM imidazole, 500 mM NaCl, 20 mM Tris-HCl, pH 7.9) and collected in 2-ml fractions. Arginase eluted in the first two fractions as determined by analysis of fractions on SDS-polyacrylamide gels. Imidazole was removed from the protein samples with a 5-ml spin column packed with Sephadex G-25 and equilibrated with 100 mM Tris-HCl buffer (pH 7.5). Protein concentrations were determined by the Bradford method (Bradford et al., *Anal. Biochem.* 72:248-254 (1976)), using bovine serum albumin as a standard. The relative purity of recombinant protein was assessed by SDS-polyacrylamide gel electrophoresis and staining of gels with Coomassie Brilliant Blue R-250.

Enzyme Assays—Frozen tomato leaves (approximately 1.5 g) were ground in liquid nitrogen with a mortar and pestle and then homogenized in 10 ml of 100 mM Tris-HCl (pH 7.5) containing 1% (v/v) 2-mercaptoethanol and 0.1 mM PMSP. Homogenates were centrifuged at 20,000×g for 10 min at 4° C., and the supernatants were used as the enzyme source. Recombinant LeARG enzyme was prepared as described above. Protein concentrations were determined as described above. Arginase activity was measured with a spectrophotometric assay for detection of urea (Alabadi et al., Plant Physiol. 112:1237-1244 (1996)), with minor modifications.

The enzyme solution was activated with 1 mM MnCl$_2$ at 37° C. for 60 min. The reaction mixture (0.5 ml) contained 10 µl of the enzyme source in assay buffer [50 mM CHES buffer (pH 9.6), 250 mM L-arginine, 2 mM MnCl$_2$]. Reactions were carried out at 37° C. for 20 min and stopped by the addition of 500 µl of 15% (v/v) perchloric acid. A 200-µl aliquot was mixed vigorously with 3 ml of acid mixture [9% (v/v) of phosphoric acid and 27% (v/v) of sulfuric acid] and 100 µl of 3% (w/v) α-isonitrosopropiophenone (Sigma) in 95% ethanol. This mixture was heated in a boiling water bath in the dark for 60 min and cooled for 10 min to room temperature. The OD$_{540}$ was recorded on a Uvikon 933 spectrophotometer (Research Instruments, San Diego, Calif.). Substrate specificity tests were performed as described above with the exception that agmatine and other related compounds were added in place of L-arginine, to a final concentration of 250 mM. Substrates tested were obtained from Sigma. Three buffer systems were used to test the effect of pH on arginase activity: 200 mM potassium phosphate, pH 7.0, 7.5, 11.0 and 12.0; 200 mM Tris-HCl, pH 7.5, 8.0, and 8.5; and 200 mM Gly-NaOH, pH 8.7, 9.0, 9.5, 10.0, and 10.5 (Alabadi et al. 1996). Inhibitor studies were conducted with test compounds that were dissolved in water and then diluted into the assay buffer at various concentrations prior to addition of enzyme. For example, 1 µl of a 5-mM L-NOHA stock was added to 489 µl of assay buffer, followed by addition of 10 µl of enzyme solution. The reaction was carried out as described above. L-NOHA was obtained from Cayman Chemical (Ann Arbor, Mich.).

Nucleic Acid Blot Analysis—

RNA blot analyses were performed as previously described (Howe et al., *Plant Physiol.* 123:711-724 (2000)). Full-length LeARG1 SEQ ID NO:02 and LeARG2 SEQ ID NO:01 cDNAs were PCR-amplified with T3 SEQ ID NO:126 and T7 SEQ ID NO:125 primers that anneal to the pBlueScript vector. Because full-length LeARG1 SEQ ID NO:02 and LeARG2 SEQ ID NO:01 cDNAs cross-hybridize to each other, a PCR-based approach was used to generate gene-specific probes corresponding to the diverged untranslated regions (UTR) of the cDNA. Primers used to generate the LeARG1-specific probe were 5'-CCC CTT CAC AAG AGA AGA AAT-3' SEQ ID NO:122 and 5'-TTC TGA TTA TCC TAC AAC TGC-3' SEQ ID NO:120. The resulting 233-bp product SEQ ID NO:121 hybridizes to the 5' UTR of LeARG1 transcripts. Primers used to generate the LeARG2-specific probe were 5'-CAA GCA AGA AGT ACC ATG TAT-3' SEQ ID NO:124 and T7 5'-TAA TAC GAC TCA CTA TAG GG-3' (T7 primer) SEQ ID NO:125, which gave a 349-bp product that included 48 bp from the pBluesript SK vector SEQ ID NO:127. This probe hybridized specifically to the 3' UTR of LeARG2 transcripts. Total RNA was extracted from various tissues of soil-grown plants. Hybridization signals on RNA blots were normalized to the signal obtained using a cDNA probe for translation initiation factor eIF4A mRNA, obtained from Clemson University (EST clone cLED1D24, herein incorporated by reference) SEQ ID NO:130. Tomato genomic DNA preparations and Southern blot analysis were as described previously (Howe et al., *Plant Physiol.* 123:711-724 (2000)).

Example 2

Phylogenetic Tree of the Arginase Superfamily

A mid-point rooted neighbor-joining phylogeny was constructed with 85 amidinohydrolase sequences from diverse organisms. Neighbor-joining bootstrap replicates were run to test the branching order reliability. Accession numbers are listed in the legend to FIG. 9A-9J, herein incorporated by reference. The four major sub-groups of the phylogeny are indicated on the right, with plant arginases in the shaded box. PAH, proclavaminate amidino hydrolase.

Example 3

Comparison of cDNA-Deduced Protein Sequences of Arginases

Members of arginase superfamily from FIG. 1 were globally aligned with the PILEUP program in GCG (Wisconsin Package version 10.2, Genetics Computer Group (GCG), Madison, Wis.). The active site region of a subset of agmatinase (AG), plant L-arginase (PA, bold) and non-plant L-arginase (NA) groups are shown. Alignment of 85 full-length sequences is shown in FIG. 9. Amino acid residues involved in binding the Mn$^{2+}$ cofactor are shaded in black; they are conserved in members of the arginase family. Residues in non-plant L-arginases that are involved in binding the guanidino moiety of the substrate are denoted with the "#" symbol and are shaded. Residues in non-plant arginases that form hydrogen bonds with the α-carboxylate oxygen and the α-amino group of L-arginine are denoted by the "*" and "^" symbols, respectively, and are shaded in gray. "Plant-specific" residues conserved in plant arginases, but not found in other family members, are indicated by gray-shaded bold letters.

Example 4

Tissue-Specific Expression of LeARG1 and LeARG2

A, Genomic DNA blot analysis of LeARG1 and LeARG2. Genomic DNA from tomato was digested with restriction enzymes BamHI (lane 1), EcoRI (lane 2), EcoRV (lane 3), HindIII (lane 4), or XbaI (lane 5), separated by agarose-gel electrophoresis, and transferred to Hybond-N Plus membranes by capillary blotting. DNA blots were hybridized to $^{32}$P-labeled probes corresponding to the full-length LeARG1 cDNA (left panel), or to gene-specific probes that recognize the 5'-untranslated region of LeARG1 (middle panel) or the 3'-untranslated region of LeARG2 (right panel). B, Accumulation of LeARG1 and LeARG2 transcripts in various tissues. Total RNA was extracted from roots (R), stems (S), and leaves (L) of 3-week-old plants, and from developing flower buds (B), mature unopened flowers (UF), mature opened flowers (OF), and small (<0.5 cm) immature green fruit (GF). RNA blots were hybridized to $^{32}$P-labeled gene-specific probes for LeARG1 and LeARG2. As a control for equal loading of RNA, a duplicate gel containing the RNA samples was stained with ethidium bromide (EtBr).

Example 5

Induction of Tomato Arginase in Response to Wounding

Leaflets on three-week-old plants were mechanically wounded with a hemostat. At the times indicated, wounded leaves were harvested for extraction of RNA or protein. A control set of unwounded plants (0 point) served as a control. A, 10-µg samples of total RNA were separated on a 1.2% (w/v) denaturing agarose gel. RNA was transferred to a Hybond-N Plus membrane, and subsequently hybridized to gene-specific probes for LeARG1 and LeARG2. A duplicate RNA gel was stained with ethidium bromide (EtBr) as loading control. B, Protein extracts prepared from wounded (closed squares) and unwounded (open squares) plants were assayed for L-arginase activity. Data points show the mean±SD of three independent assays. Note that the time scale for the experiments shown in A and B are in hours and days, respectively.

Example 6

Induction of Tomato Arginase in Response to MeJA Treatment

Three three-week-old tomato plants were exposed to MeJA vapor in an enclosed Lucite box. At various times thereafter, leaves were harvested for extraction of RNA or protein. A control set of untreated plants (0 point) served as a control. A, Total RNA was analyzed by blot hybridization for the presence of LeARG1 and LeARG2 transcripts as described in the legend to FIG. 4. A duplicate RNA blot was hybridized to a probe for eIF4A as a loading control. B, Protein extracts prepared from MeJA-treated (closed square) or mock-treated (open squares) plants were assayed for L-arginase activity. Data points show the mean±SD of three independent assays. Note that the time scale for the experiments shown in A and B are in hours and days, respectively.

Example 7

Induced expression of tomato arginase is dependent on the JA signaling pathway

A, Three sets of four-week-old wild-type (WT) and jai1 plants were grown under identical conditions. One set of plants was mechanically wounded (W), and RNA was extracted 8 h later. RNA also was prepared from a second set of plants that was treated with exogenous MeJA (MJ) for 8 h. A third set of control plants (C) received no treatment. Total RNA was analyzed by blot hybridization for the presence of LeARG1 and LeARG2 transcripts as described in the legend to FIG. 4. A duplicate RNA blot was hybridized to a probe for eIF4A as a loading control. B, Plants were treated as described in A. Two days after treatment, protein extracts were isolated from leaf tissue and assayed for L-arginase activity. Data points show the mean±SD of three independent measurements.

Example 8

Induction of tomato arginase in response to Pst DC3000 infection

Three 3-week-old tomato plants were infected either with a strain of *P. syringae* that produces coronatine (Pst DC3000, COR⁺) or an isogenic strain that does not produce the phytotoxin (Pst DC3118, COR⁻). On consecutive days post-infection (dpi), leaves were harvested for extraction of RNA or protein. A control set of mock (water)-inoculated plants (0 point) served as a control. A, Total RNA was analyzed by blot hybridization for the presence of LeARG1 and LeARG2 transcripts as described in the legend to FIG. 4. A duplicate RNA blot was stained with ethidium bromide as a loading control. B, Protein extracts prepared from mock-inoculated plants (closed circles) and from plants challenged with Pst DC3000 (closed square) or Pst DC3118 (open squares) were assayed for L-arginase activity. Data points show the mean±SD of three independent measurements.

Example 9

Induction of Tomato Arginase in Response to Purified Coronatine

Purified coronatine (20 ng) was applied directly to the leaf surface of three 3-week-old tomato plants. At various times thereafter, leaves were harvested for extraction of RNA or protein. A control set of untreated plants (0 point) served as a control. A, Total RNA was analyzed by blot hybridization for the presence of LeARG1 and LeARG2 transcripts as described in the legend to FIG. 4. A duplicate RNA blot was stained with ethidium bromide (EtBr) as a loading control. B, Protein extracts prepared from mock-treated (open squares) or COR-treated (closed squares) leaves were assayed for L-arginase activity. Data points show the mean±SD of three independent measurements.

Example 10

Construction of ARG-OE transgenic tomato lines

A 1218-bp fragment containing SmaI and SacI sites was amplified from LeARG2 EST clone cTOC4L10, herein incorporated by reference, and digested with SmaI and SacI. This fragment was cloned into the SmaI and SstI sites of the binary vector pBI121 (Clontech, Palo Alto, Calif.) under the control of the 35S promoter of Cauliflower mosaic virus. The resulting construct was transformed into *Agrobacterium tuinefaciens* strain AGLO (Lazo et al., (1991) A DNA transformation-competent *Arabidopsis* genomic library in *Agrobacterium*. Biotechnology 9, 963-967). *Agrobacterium*-mediated transformation of tomato (*Lycopersicon esculentum* cv MicroTom) cotyledon explants was performed according to McCormick (McCormick, (1991) Transformation of tomato with *Agrobacterium tumefaciens*. In: K. Lindsey (Ed.) Plant Tissue Culture Manual, Kluwer Academic Publishers, Dordrecht, Netherlands, B6, pp. 1-9). Regenerated kanamycin-resistant transformants were potted into standard soil mix and grown in a growth chamber under standard conditions.

Seventy-seven independent primary transformants (T0) were regenerated on kanamycin-containing medium and transferred to the greenhouse for collection of seeds. Only 16 lines that produced considerable amount seeds (>50) were assayed for arginase activity. Three of them had a higher arginase activity (lines 20, 28, and 39). T1 and T2 plants from line 39 were screened for the presence of the ARG-OE transgene by PCR, with a primer set of 35S-1 (5'-CCT TCG CAA GAC CCT TCC TCT AT-3' SEQ ID NO:151) and ARG2-S2 (5'-GAC ATC AGC ACC AAG GAT ATC A-3' SEQ ID NO:152). These primers were designed to amplify a 1023-product from the 35S::LeARG2 transgene, SEQ ID NO:153. Lines were also screened for arginase activity.

TABLE 1

Substrate specificity of tomato arginases
Reaction mixtures (500 µl) containing 10 µl of enzyme source and 250 mM of the indicated substrate in a solution of 50 mM CHES buffer (pH 9.6) and 2 mM $MnCl_2$ were incubated at 37° C. for 30 min. Reactions were terminated by the addition of 500 µl of 15% (v/v) perchloric acid. Enzyme activity was measured by spectrophotometric detection of urea as described in Experimental Procedures. To correct for effects of non-enzymatic hydrolysis of the substrate, a mock reaction in which the enzyme was omitted was performed in parallel. The resulting spectrophotometric absorbance was subtracted from that obtained with the enzyme-containing reaction. Values shown represent the mean and SD of triplet reactions. Values in parenthesis indicate the amount of activity relative to that obtained with L-arginine.
nd, not detectable.

| | Activity (µmol/mg protein/h) | | |
|---|---|---|---|
| Substrate | LeARG1 | LeARG2 | Bovine arginase |
| L-Arginine | 8848 ± 177 (100%) | 7016 ± 86 (100%) | 6608 ± 351 (100%) |
| Homoarginine | 1269 ± 2 (14%) | 916 ± 16 (13%) | nd |
| D-Arginine | 195 ± 2 (2.2%) | 250 ± 5 (3.6%) | 32 ± 13 (0.5%) |
| Agmatine | 40 ± 3 (0.5%) | 41 ± 6 (0.6%) | 12 ± 2 (0.2%) |
| Canavanine | 3 ± 1 (<0.1%) | 9 ± 1 (0.1%) | 14 ± 2 (0.2%) |

TABLE 2

Effect of various compounds on arginase activity
Arginase activity was measured in the presence of 25 mM L-arginine and various compounds at the indicated concentration. Values represent the mean activity determined from triplet reactions, expressed as a percentage of a control reaction with L-arginine.

| | Concentration | Relative activity (%) | |
|---|---|---|---|
| Compound | (mM) | LeARG1 | LeARG2 |
| Control | | 100 | 100 |
| L-NOHA | 0.2 mM | 7 | 5 |
| Sodium nitroprusside | 2.0 mM | 102 | 105 |
| L-Ornithine | 5.0 mM | 72 | 88 |
| 3-Mercaptopropionate | 5.0 mM | 24 | 26 |
| 2-Mercaptopropionate | 5.0 mM | 38 | 38 |
| 2-Mercaptoethanol | 5.0 mM | 81 | 80 |
| Mercaptoacetate | 5.0 mM | 28 | 26 |

TABLE 3

Tomato arginases compared to enzymes in other plants and organisms.

| Species | SEQ ID NO:XX | Homology (%) to LeARG2 (NA) | SEQ ID NO:XX | Homology (%) to LeARG2 (AA) |
|---|---|---|---|---|
| LeARG2 | SEQ ID NO:01 | 100 | SEQ ID NO:54 | 100 |
| LeARG1 | SEQ ID NO:02 | 92 | SEQ ID NO:55 | 89 |
| Le | SEQ ID NO:03 BT013286 | 92 | SEQ ID NO:56 | 89 |
| Le | SEQ ID NO:04 TC142949 | 91 | SEQ ID NO:67 TC142949 | 100 |
| S. tuberosum (potato) | SEQ ID NO:05 TC94228 | 92 | SEQ ID NO:58 | 89 |
| Z. mays (Maize) | SEQ ID NO:23 AY106166 | 82 | SEQ ID NO:74 AY106166 | 81 |
| O. sativa arginase | XX | XX | SEQ ID NO:78 CAE02758 | 81 |
| O. sativa arginase | SEQ ID NO:27 XM_470981 | 80 | SEQ ID NO:77 XM_470981 | 81 |
| Gossypium Cotton | SEQ ID NO:21 TC32845 | 79 | SEQ ID NO:72 TC32845 | 84 |
| M. truncatula (barrel medic) | SEQ ID NO:33 TC87301 | 78 | SEQ ID NO:83 TC87301 | 80 |
| L. japonicus | SEQ ID NO:49 | 77 | SEQ ID NO:XX | 78 |
| A. thaliana arginase | SEQ ID NO:07 ATU15019 | 76 | SEQ ID NO:XX | 84 |
| A. thaliana 1 arginase | SEQ ID NO:08 AY052276 | 76 | SEQ ID NO:61 AAK96469 | 84 |
| A. thaliana 2 arginase | SEQ ID NO:09 AY087307 | 76 | SEQ ID NO:62 AAM64858 | 80 |
| B. napus arginase | SEQ ID NO:14 AF233433 | 76 | SEQ ID NO:XX AAK15006 | 84 |

TABLE 3-continued

Tomato arginases compared to enzymes in other plants and organisms.

| Species | SEQ ID NO:XX | Homology (%) to LeARG2 (NA) | SEQ ID NO:XX | Homology (%) to LeARG2 (AA) |
|---|---|---|---|---|
| G. max soybean | SEQ ID NO:12 TC215865 | 77 | SEQ ID NO:65 TC215865 | 74 |
| G. max soybean | SEQ ID NO:10 AF035671 | 76 | SEQ ID NO:63 AF035671 | 72 |
| G. max soybean | SEQ ID NO:11 TC181483 | 77 | SEQ ID NO:XX TC181483 | 75* |
| G. max soybean | SEQ ID NO:13 TC219468 | 76 | SEQ ID NO:64 TC219468 | 79 |
| T. aestivum (wheat) | SEQ ID NO:25 TC108421 | 76 | SEQ ID NO:76 | 80 |
| Allium cepa (onion) | SEQ ID NO:30 TC890 | 75 | SEQ ID NO:80 TC890 | 79 |
| C. annuum (pepper) | SEQ ID NO:31 TC2786 | 90* | SEQ ID NO:81 TC2786 | 89* |
| V. vinifera var. Cabernet Sauvignon | SEQ ID NO:19 TC47457 | 81 | SEQ ID NO:70 TC47457 | 83 |
| S. officinarum (sugar cane) | SEQ ID NO:20 | 77 | SEQ ID NO:71 | 79 |
| H. vulgare (barley) | SEQ ID NO:24 | 76 | SEQ ID NO:75 | 80 |
| S. bicolor sorghum | SEQ ID NO:22 TC103916 | 76 | SEQ ID NO:73 TC103916 | 81 |
| M. crystallinum (common iceplant) | SEQ ID NO:29 BE036933 | 76 | SEQ ID NO:XX | XX |
| Populus (Poplar) | SEQ ID NO:16 TC4665 | 76 | SEQ ID NO:68 TC4665 | 80 |
| P. glauca (white spruce) | SEQ ID NO:17 | 85* | SEQ ID NO:69 | 84* |
| P. (Poplar) | SEQ ID NO:28 | 76* | SEQ ID NO:68 | 80* |
| P. taeda loblolly pine arginase | SEQ ID NO:15 AF130440 | 73 | SEQ ID NO:157 AAK07744 | 78 |
| D. melanogaster | SEQ ID NO:36 | NSH | SEQ ID NO:86 | 23 |
| D. rerio | SEQ ID NO:37 BC056711 | NSH | SEQ ID NO:87 AAH56711 | 25 |
| Xenopus (frog) | SEQ ID NO:38 | NSH 60*** | SEQ ID NO:88 BC043635 | 23 |
| Gallus gallus arginase | SEQ ID NO:39 AF401291 | NSH 84.6*** | SEQ ID NO:89 AAK97629 | 33 |
| R. norvegicus rat liver | SEQ ID NO:40 NM_017134 | NSH 55.2*** | SEQ ID NO:90 NP_058830 | 24 |
| R. norvegicus arginase II | SEQ ID NO:41 NM_019168 | NSH 77.2*** | SEQ ID NO:91 NP_062041 | 23 |
| M. musculus arginase | SEQ ID NO:42 BC050005 | NSH 56.7*** | SEQ ID NO:92 AAH50005 | 25 |
| M. musculus arginase II | SEQ ID NO:43 BC023349 | NSH 56*** | SEQ ID NO:93 AAH23349 | 23 |

TABLE 3-continued

Tomato arginases compared to enzymes in other plants and organisms.

| Species | SEQ ID NO:XX | Homology (%) to LeARG2 (NA) | SEQ ID NO:XX | Homology (%) to LeARG2 (AA) |
|---|---|---|---|---|
| *Sus scrofa* (pig) | SEQ ID NO:44 AY039112 | NSH | SEQ ID NO:94 AAK91874 | 25 |
| *H. sapiens* 1 arginase | SEQ ID NO:45 M14502 | NSH 58.8*** | SEQ ID NO:95 AAA51776 | 25 |
| *H. sapiens* 2 arginase | SEQ ID NO:46 D86724 | NSH 70.3*** | SEQ ID NO:96 BAA13158 | 23 |
| *B. japonicum* | XX | XX | SEQ ID NO:97 NP_772762 | 27 |
| *S. cerevisiae* (baker's yeast) | SEQ ID NO:47 M10110 | NSH 51.5*** | SEQ ID NO:104 AAA34469 | 27 |
| *S. pombe* fission yeast) | SEQ ID NO:52 X75559 | NSH 51.6*** | SEQ ID NO:105 CAA53236 | 25 |
| *A. tume faciens* 1 | XX | XX | SEQ ID NO:98 NP_356634; | 28 |
| *A. tume faciens* 2 | SEQ ID NO:48 X15884 | NSH 52.3*** | SEQ ID NO:99 CAA33894; | 28 |
| *P. yoelii* | XX | XX | SEQ ID NO:101 EAA16981 | 26 |
| *B. subtilis* | XX | XX | SEQ ID NO:107 CAA57400; | 26 |
| *B. brevis* | XX | XX | SEQ ID NO:120 JC5866; | 33 |
| *B. melitensis* biovar Abortus (*Brucella abortus*) | XX | XX | SEQ ID NO:100 AAC05588 | 31 |

\* = partial SEQ
\*\* = homologous within potential active region
\*\*\* = homology to small regions using align not BLAST
NSH = no significant homology
XX = not available

TABLE 4

Tomato cystatin (cysteine proteinase inhibitor) compared to enzymes in other plants and organisms.

| Species | SEQ ID NO:XX | Homology (%) to *Le cystatin* (NA) | SEQ ID NO:XX | Homology (%) to *Le cystatin* (AA) |
|---|---|---|---|---|
| *Le cystatin* | SEQ ID NO:158 AF198388 | 100 | SEQ ID NO:159 AAF23126 | 100 |
| *Petunia x hybrida* | SEQ ID NO:160 AY662997 | 85 | SEQ ID NO:161 AAU81597 | 78 |

\* = partial SEQ
\*\* = homologous within potential active region
\*\*\* = homology to small regions using align not BLAST
NSH = no significant homology
XX = not available

TABLE 5

Comparison of larval growth on ARG2-OE plants and on the wild-type WT control.

| Group | Number of hornworms | Weight (g) | Feeding time on plants | t-test |
|---|---|---|---|---|
| Experiment 1 | | | | |
| WT | 10 | 5.95 ± 3.30 | 13 days | P < 0.01 |
| ARG2-OE | 13 | 2.96 ± 1.40 | 13 days | |
| Experiment 2 | | | | |
| WT | 21 | 2.72 ± 1.20 | 10 days | P < 0.001 |
| ARG2-OE | 21 | 1.28 ± 0.43 | 10 days | |

Example 11

LC-MS/MS-Based Identification of Midgut Proteins of *M. sexta*

Tomato (*Lycopersicon esculentum* cv, Castlemart) was used as the WT. Mutant lines and conditions for plant growth are described in Li et al. "The tomato homolog of CORONATINE-INSENSITIVE1 is required for the maternal control of seed maturation, jasmonate-signaled defense responses, and glandular trichome development" Plant Cell 16, 126-43 (2004); Li et al., "Resistance of cultivated tomato to cell content-feeding herbivores is regulated by the octadecanoid-signaling pathway" Plant Physiol 130, 494-503 (2002); and Li, C. et al., "Role of {beta}-Oxidation in Jasmonate Biosynthesis and Systemic Wound Signaling in Tomato" Plant Cell (2005). *M. sexta* eggs were obtained from the Department of Entomology, North Carolina State University (Raleigh, N.C.). Hatched larvae were reared on artificial diet (Carolina Biological Supply, Burlington, N.C.) for 4-6 days prior to transfer to 6-week-old tomato plants. Midguts were obtained from $4^{th}$-$5^{th}$ instar larvae that were actively feeding at the time of harvest. Larvae were frozen in liquid nitrogen and stored at −20° C. until further use. Frozen larvae were transected on dry ice behind the fourth pair of abdominal appendages and behind the second pair of thoracic appendages. The integument and midgut were dissected to obtain the midgut content.

Total midgut content was ground in liquid nitrogen to fine powder and extracted with 100 mM Tris buffer (pH 7.5) containing 1 mM EDTA, 1% (v/v) β-mercaptoethanol, and 0.1 mM PMSF (phenylmethylsulfonyl fluoride). Extracts were centrifuged at 20,000×g for 10 min, and the protein concentration in the resulting supernatant was determined as described in Chen et al., "Regulation of plant arginase by wounding, jasmonate, and the phytotoxin coronatine" J Biol Chem 279, 45998-6007 (2004). Sixty μg of total protein was electrophoresed through a 4% SDS-polyacrylamide stacking gel (1.5 cm) and ~1 cm into a 12% resolving gel. Gels were stained with Coomassie Blue and the protein-stained region of the gel was excised. Proteins within the gel piece were reduced and alkylated followed by digestion with typsin as described in Rowley, A. et al. "Applications of protein mass spectrometry in cell biology" Methods 20, 383-397 (2000). Extracted peptides were loaded onto a 100×0.032 mm SCX column (Thermo Electron Corp.). Peptides were sequentially eluted with five NH$_4$Cl steps (0, 20, 60, 250, and 500 mM) from the SCX column onto a C18 column. The reverse-phase capillary HPLC column contains 5 mm Magic C18AQ stationary phase (Michrom Bioresources, Auburn, Calif.) in a 75-μm i.d., 10-cm length capillary (New Objective, Woburn, Mass.). Peptides were eluted from the C18 column over 50 minutes with a gradient of 5% B to 80% B (mobile phase A=0.1% formic acid, mobile phase B=95% acetonitrile, 0.1% formic acid) at a flow rate of 200 nl/min.

Peptides eluting from the C18 column were directly sprayed into a Thermo-Electron LTQ-FTMS mass spectrometer. The six most abundant ions in each FT survey scan (100,000 resolution, 3 ppm minimum mass accuracy) were subjected to low energy collision induced dissociation and the resulting fragments were analyzed in the linear ion trap portion of the instrument. The tandem algorithm as described in Craig & Beavis "TANDEM: matching proteins with tandem mass spectra" Bioinformatics 20, 1466-1467 (2004) and Craig & Beavis "A method for reducing the time required to match protein sequences with tandem mass spectra" Rapid Communications In Mass Spectrometry 17, 2310-2316 (2003) was used to search MS/MS spectra against 2,614 *S. lycopersicum* (formerly *L. esculentum*) and 1,441 *Bombyx mori* protein sequences found in GenBank as of Jun. 28, 2005. Identifications were considered positive if the protein probability score was P<0.01.

Midgut protein extracts were prepared as described above. Enzyme extracts from tomato tissues were prepared and assayed for ARG activity as described in Chen et al., "Regulation of plant arginase by wounding, j asmonate, and the phytotoxin coronatine" J Biol Chem 279, 45998-6007 (2004). TD assays were performed according to the method of Sharma and Mazumder "Purification, properties, and feedback control of L-threonine dehydratase from spinach" J Biol Chem 245, 3008-14 (1970). Crude protein extracts that were used for Ile inhibition assays were desalted on a Sephadex G-25 column (Amersham Biosciences, Uppsala, Sweden) that was equilibrated with 100 mM Tris-HCl (pH 7.5). L-Ile was added to the assay buffer [150 mM Tris-HCl (pH 9.0), 10 μM L-Thr, and 12 mM KCl] prior to the addition of enzyme extract, and TD activity was then measured.

Free amino acid levels were determined with the Waters AccQTag procedure (Waters Corp., Milford, Mass.). Isolated midgut content was ground in liquid nitrogen. The frozen powder (~200 mg) was transferred to 1.5-ml Eppendorff tube and extracted with 1 ml of a 1:1 mixture of chloroform and water. L-nor-leu was added as an internal standard. After centrifugation at 20,000×g for 10 min, the supernatant was diluted 10-fold with H$_2$O and filtered through a 0.45 μm filter (Millipore). Samples (20 μl) were derivatized and analyzed by HPLC as described by the manufacturer. Extracts were separated on a Waters AccQTag column that was maintained at 37° C. and run at a flow rate of 1.0 ml/min. HPLC was performed with a Waters liquid chromatography system equipped with a model 600 pump, a 2475 fluorescence detector, and a 717-plus autosampler.

TABLE 6

List of JA-regulated tomato proteins identified in the midgut of *M. sexta* larvae grown on 35S-PS and WT plants, but not in midguts from larvae reared on jail plants.

| | | | No. unique peptides (% coverage) | | |
|---|---|---|---|---|---|
| Protein ID | GenBank | Mr | jail | WT | 35S-PS |
| JIPs | | | | | |
| Leucine Amino Peptidase | gi|2492529 | 60.2 | Nd | 15 (40.6) | 25 (71.6) |
| Threonine Deaminase | gi|100257 | 64.9 | Nd | 13 (29.6) | 31 (50.9) |

TABLE 6-continued

List of JA-regulated tomato proteins identified in the midgut of
M. sexta larvae grown on 35S-PS and WT plants, but not in midguts
from larvae reared on jail plants.

| Protein ID | GenBank | Mr | No. unique peptides (% coverage) | | |
|---|---|---|---|---|---|
| | | | jail | WT | 35S-PS |
| Cathepsin D Inhibtor | gi\|9581827 | 24.2 | Nd | 7 (43.2) | 10 (60.5) |
| Arginase2 | gi\|54648782 | 36.9 | Nd | 3 (21.3) | 12 (57.1) |
| Trypsin Inhibitor-like | gi\|1362094 | 25.2 | Nd | 6 (32.4) | 8 (32.9) |
| Reference protein | | | | | |
| Plastocyanin | gi\|130271 | 17.0 | 4 (40.0) | 4 (38.2) | 3 (42.9) |

The number of unique peptide fragments identified for each protein by LC-MS/MS, and the percent of the full-length protein sequence that was covered by the unique peptides (% coverage) is indicated. Plastocyanin was used as a reference protein for normalization of spectral count data obtained for each protein. Nd, not detected.

```
                                         SEQ ID NO:191
Accession No. Q10712, Aminopeptidase 1, chloro-
plast precursor (Leucine aminopeptidase)
MATLRVSSLF ASSSSSLHSN PSVFTKYQSS PKWAFSFPVT

PLCSKRSKRI VHCIAGDTLG LTRPNESDAP KISIGAKDTA

VVQWQGDLLA IGATENDMAR DENSKFKNPL LQQLDSELNG

LLSAASSEED FSGKSGQSVN LRFPGGRITL VGLGSSASSP

TSYHSLGQAA AAAAKSSQAR NIAVALASTD GLSAESKINS

ASAIATGVVL GSFEDNRFRS ESKKSTLESL DILGLGTGPE

IERKIKYAEH VCAGVILGRE LVNAPANIVT PAVLAEEAKK

IASTYSDVIS VNILDAEQCK ELKMGAYLAV AAAATENPPY

FIHLCFKTPT KERKTKLALV GKGLTFDSGG YNLKVGARSR

IELMKNDMGG AAAVLGAAKA LGEIRPSRVE VHFIVAACEN

MISAEGMRPG DIVTASNGKT IEVNNTDAEG RLTLADALIY

ACNQGVEKII DLATLTGAIM VALGPSVAGA FTPNDDLARE

VVEAAEASGE KLWRMPMEES YWESMKSGVA DMINTGPGNG

GAITGALFLK QFVDEKVQWL HLDVAGPVWS DEKKNATGYG

VSTLVEWVLR N
                                         SEQ ID NO:192
Accesion No. CAC00536 Cathepsin D Inhibitor
[Lycopersicon esculentum]
MMKCLFLLCL CLFPIVVFSS SFTSQNPIEL PSASPKPNPV

LDTNGNELNP NSSYRIISTF WGALGGDVYL GKSPRSSAPC

LDGVFRYNSD VGTVGTPVRF IPLSGGIFED QLMNLQFNIA

TVKLCVSYTI WKAGNLNAYY RAMLLETGGS IGQVDSSYFK

IVKASTFGYN LLYCPITRPV LCPFCRGDDF CAKVGVINQD

GRRRLALVNE NPLGVYFKKV.
                                         SEQ ID NO:193
Accession No. S57810 plant Kunitz-type proteinase
inhibitor, hypothetical protein precursor (clone
TPP11)-tomato
MMKSLVLFVS IALCVPLALS STFSSDLLLP SDEVVPNGKT

YASVVDSDGN PVKAGAKYFV LPSLRGSGGG LVLSRVVDKN

VKVCPQDIVQ EPQELNTGRP VEFFPAYPNK TGEIIKVNNP

INVNFFSLSK TSRCANFTVW KMDKKYKYVV GRGTLGALNR

IRNWFRIVPY GKGYRFVYCP SLCVPCKIRC FDLPISYEER

ENVQVRRLAA SDNELPFSVY FKKAD
```

All publications and patents mentioned in the above specification are herein incorporated by reference. Various modifications and variations of the described methods and system of the invention will be apparent to those skilled in the art without departing from the scope and spirit of the invention. Although the invention has been described in connection with specific preferred embodiment, it should be understood that the invention as claimed should not be unduly limited to such specific embodiment. Indeed, various modifications of the described modes for carrying out the invention which are obvious to those skilled in the art and in fields related thereto are intended to be within the scope of the claims.

SEQUENCE LISTING (293 sequences)

SEQ ID NO: 1 - DNA, 1360 bp, Lycopersicon esculentum
gttcttgtagtaaacaaatatgaagagtgctggaagtatgggaatcaactatatgcagaaattgctaacgtcaaatgttccaaaagaagtagtcaaaagaggacaggatcgtgttgtagaggcatctcttacacttattcgtgaaagagcaaaacttaagggagagcttgttcgtggacttggaggtgcagtagcgtcaacgtcacttcttggaattcctctgggacacaactcttcatttctccagggccctgcatttgctcctcctcttatacgagaggctatttggtgtggcagtacaaactccacaactgaggaaggaaaaatattagatgatcaacgtgtcttaactgatgttggtgatctgccagtacaagagttacgagacacaggcatagatgacgataggttgatgagtacagtaagtgaatctgtcaagctagttatggacgagaatccattgcgccccttggtgttagggggtgatcactctatatcctatcctgttgtaagagctgtgtctgaaaagcttggaggacctgttgatatccttcaccttgatgctcatcctgacatttatgatgcatttgaaggaaacaaatactcacatgcatcaagctttgcacgaataatggagggtggttatgctcgacgccttttgcaagttggaattagatcaattaatctagaaggtcgagaacaaggaaaaaggtttggtgtggagcaatatgaaatgcgaacattttccagagacagacaatttttggagaatctgaaacttggtgaaggtgtaaagggcgtgtatatatccgtggatgttgactgtttggatccagcatttgctcctggagtatctcattttgagtcaggcggtctctcgttccgcgatgttctaaacatactgcataaccttcaaggtgatatcgttggtgctgatgtcgttgagtacaacccacagcgtgatactgctgatggcatgactgcaatggttgctgcgaagctggtaagagaacttgctgccaagatgtccaagtgacctgcagtaattttcaattttaacaagcaagaagtaccatgtatcctattagtgtactcatctttatgcgaaaataagtgtttattcacattaggtaggtctggcagatgctcagtttcctatggcaagggggattgggattatctgtaaacttgcctcccaaaataagctagtatatttgcagttccttatgagtaacctgttgttgtaagtgacacttgtatcatttggtatggagtttgttgtgtatggatgttttgaatcttaaaaaaaaaaaaaaaaaaaaaaaaaaaaaaaaaaaaaaaaaaaaaaaaaaaaaaaaaa

SEQ ID NO: 2 - DNA, 1508 bp, Lycopersicon esculentum
gcacgagggtccccttcacaagagaaatggattggcttaatcagtcggtgattacgtgtaaattgtgctaatctccgttgcctaataacaatatttccattttcatactccacccgctgcaagcaccaaatcccattatattactactaaaaacgactgcatgtcttcttcttttttaaactcagcgattgccttctttttttgctctcatcactctttcttgcagttgtaggataatcagaataaacaaatatgaggagtgctggaagaatgggaatccattatatgcagaaattgcacgcgtcaaatgttccaaaagaattggtggaaaaaggacagaatcgtgttatagaggcatctcttacacttattcgtgaaagagcaaaacttaagggagagcttgttcgtgctcttggaggtgctgtagcctcaacgtctcttcttggagttcctctgggacataactcttcatttctccaggggccagcatttgctcctcctcgtatacgagaggctatgtggtgtggcagtacaaactctacaactgaggaaggaaaagaattagatgatccacgcatcttaactgatgttggtgatgtgcctgtgcaagagttacgagatgcaggtgtagatgatgataggttaatgagtatcataagcgaatctgtcaagctagttatggaagagaatccattgcgccccttggtgttagggggtgatcactctatatcctatcctgttgtaagagctgtgtctgaaaagcttggagggcctattgatatccttcaccttgatgctcatcctgacatttatcatgcctttgaaggaaacaaatactcacatgcatcaagctttgcacggataatggagggtggttatgctcgacggcttttgcaagtgggaattagatcaattaataaagaaggtcgagaacaaggaaaaaggttcggtgtggagcaatatgaaatgcgaacattttcccaagaccgacaatttttggagaatctgaaacttggcgaaggtgtgaagggcgtgtatatctcagtggatgttgactgtatggatccagcatttgctcctggagtatctcatatagaaccaggaggtctctctttccgcgatgttctaaacatactgcataaccttcaagctgatgttgttggtgctgatgtggttgagttcaacccgcagcgtgatactgttgatggcatgactgcaatggttgctgcgaagctggtaagagaacttactgccaagatatccaagtgacctgcagtaatttctaaaattatgaaggaagaattaccatgcatccaatagagaccactagatttgtactcatctttactggggaggtttaacagagaataagcaccaaaatgaagtgtttattcaccttattgtaactctaaaactaaaagctatatttgcagttcattatgaggaccctgtgattcttataatcttttaagtggtgcaaaaaaaaaaaaaaaaaaaaaaaaaaaaaa

SEQ ID NO: 3 - DNA, 1497 bp, Lycopersicon esculentum
tccccttcacaagagaaatggattggcttaatcagtcggtgattacgtgtaaattgtgctaatctccgttgcctaataacaatatttccattttcatactccacccgctgcaagcaccaaatcccattatattactactaaaaacgactgcatgtcttcttcttttttaaactcagcgattgccttctttttttgctctcatcactctttcttgcagttgtaggataatcagaataaacaaatatgaggagtgctggaagaatgggaatccattatatgcagaaattgcacgcgtcaaatgttccaaaagaattggtggaaaaaggacagaatcgtgttatagaggcatctcttacacttattcgtgaaagagcaaaacttaagggagagcttgttcgtgctcttggaggtgctgtagcctcaacgtctcttcttggagttcctctgggacataactcttcatttctccaggggccagcatttgctcctcctcgtatacgagaggctatgtggtgtggcagtacaaactctacaactgaggaaggaaaagaattagatgatccacgcatcttaactgatgttggtgatgtgcctgtgcaagagttacgagatgcaggtgtagatgatgataggttaatgagtatcataagcgaatctgtcaagctagttatggaagagaatccattgcgccccttggtgttagggggtgatcactctatatcctatcctgttgtaagagctgtgtctgaaaagcttggagggcctattgatatccttcaccttgatgctcatcctgacatttatcatgcctttgaaggaaacaaatactcacatgcatcaagctttgcacggataatggagggtggttatgctcgacggcttttgcaagtgggaattagatcaattaataaagaaggtcgagaacaaggaaaaaggttcggtgtggagcaatatgaaatgcgaacattttcccaagaccgacaatttttggagaatctgaaacttggcgaaggtgtgaagggcgtgtatatctcagtggatgttgactgtatggatccagcatttgctcctggagtatctcatatagaaccaggaggtctctctttccgcgatgttctaaacatactgcataaccttcaagctgatgttgttggtgctgatgtggttgagttcaacccgcagcgtgatactgttgatggcatgactgcaatggttgctgcgaagctggtaagagaacttactgccaagatatccaagtgacctgcagtaatttctaaaattatgaaggaagaattaccatgcatccaatagagaccactagatttgtactcatctttactggggaggtttaacagagaataagcaccaaaatgaagtgtttattcaccttattgtaactctaaaactaaaagctatatttgcagttcattatgaggaccctgtgattcttataatcttttaagtggtgcaaaaaaaaaaaaaaaaaaaaaaaaaaaa

SEQ ID NO: 4 - DNA, 1394 bp, Lycopersicon esculentum
cttcatttcttgtgtagtcacttcctcctttattctttgtttactttaatttccagctctttcggtttctgcatttttttttatatatttttcctttttgttgtgttgaatcagagtaaacaaatatgaagagtgctggaagtatgggaatcaactatatgcagaaattgctaacgtcaaatgttccaaaagaagtagtcaaaagaggacaggatcgtgttgtagaggcatctcttacacttattcgtgaaagagcaaaacttaagggagagcttgttcgtggacttggaggtgcagtagcgtcaacgtcacttcttggaattcctctgggacacaactcttcatttctccagggccctgcatttgctcctcctcttatacgagaggctatttggtgtggcagtacaaactccacaactgaggaaggaaaaatattagatgatcaacgtgtcttaactgatgttggtgatctgccagtacaagagttacgagacacaggcatagatgacgataggttgatgagtacagtaagtgaatctgtcaagctagttatggacgagaatccattgcgccccttggtgttagggggtgatcactctatatcctatcctgttgtaagagctgtgtctgaaaagcttggaggacctgttgatatccttcaccttgatgctcatcctgacatttatgatgcatttgaaggaaacaaatactcacatgcatcaagctttgcacgaataatggagggtggttatgctcgacgccttttgcaagttggaattagatcaattaatctagaaggtcgagaacaaggaaaaaggtttggtgtggagcaatatgaaatgcgaacattttccagagacagacaatttttggagaatctgaaacttggtgaaggtgtaaagggcgtgtatatatccgtggatgttgactgtttggatccagcatttgctcctggagtatctcattttgagtcaggcggtctctcgttccgcgatgttctaaacatactgcataaccttcaaggtgatatcgttggtgctgatgtcgttgagtacaacccacagcgtgatactgctgatggcatgactgcaatggttgctgcgaagctggtaagagaacttgctgccaagatgtccaagtgacctgcagtaattttcaattttaacaagcaagaagtaccatgtatcctattagtgtactcatctttatgcgaaaataagtgtttattcacattaggtaggtctggcagatgctcagtttcctatggcaagggggattgggattatctgtaaacttgcctcccaaaataagctagtatatttgcagttccttatgagtaacctgttgttgtaagtgacacttgtatcatttggtatggagtttgttgtgtatgg

SEQ ID NO: 5 - DNA, 1321 bp, Solanum tuberosum
tactaaaaacgactgcatgtcttctcttctttacctctatctattcaacaactctttcttaaactctgcgattgccttcttttttgctctcatcactctttcttgcagttgtaggataatcagaataaacaaatatgaagaatgctggaagaatgggaatccattatatgcagaaattgcacgcgtcaaatgttccaaaagaattggtggaaaaaggacagaatcgtgttatagaggcatctcttacacttattcgtgaaagagcaaaacttaagggagagcttgtccgtgctcttggaggtgctgtagcctcaacgtctcttcttggagttcctctgggacataactcctcatttctccaggggccagcatttgctcctcctcgtatacgagaggctatgtggtgtggcagtacaaactctacaactgaggaaggaaaagaattagatgatccacgcatcttaactgatgttggtgatgtgcctgttcaagagttacgagatgcaggcgtagatgatgataggttgatgagtatcataagtgaatctgtcaagctagttatggaggagaatccattgcgccccttggtgttagggggtgatcactctatatcctatcctgttgtaagagctgtgtctgaaaagcttggaggtcctattgatatccttcaccttgatgctcatcctgacatttatgatgcatttgaaggaaacaaatactcacatgcatcaagctttgcacgaataatggagggtggttatgctcgacggcttttgcaagtgggaattagatcaattaataaagaaggtcgagaacaaggaaaaaggttcggtgtggagcaatatgaaatgcaaacatattcccaagaccgacaatttttggagaatctgaaacttggcgaaggtgtgaagggcgtgtatatctccgtggatgttgactgtatggatccagcatttgctcctggagtatctcatatagaaccaggaggtctctctttccgtgatgttctaaacatactgcataaccttcaagctgatgttgttggtgctgatgtcgttgagttcaacccacagcgtgatactgttgatggcatgactgcaatggttgctgcgaagctggtaagagaacttactgccaagatatccaagtgacctgcaggaattctgaatttatcaaggaaagaagaagtaccatgcatcctatagaggactgctagatttgtactcatcaagtttaacagagaataagcaccaaaggaagtgtttattcaccttattgtaactctgaaactaaaagcatactaggacttaaaatttaatta

SEQ ID NO: 6 - DNA, 1360 bp, Lotus japonicus
tgggtacgggccccccttcaagtctagtgtcattaatttctacaggcagagaattggtgagatcaaacaatgtttcctaaaggaatgtcaactatagcccgcagaggcatccattacatgcaggaaatacaggcagcaaaagtatctcctgcttccctagagcaaggccaaaagggtgtgatagaagcttccctagcacttattcgagaaaatgcaaagctcaagggagaacttgtgcgtgcttatggaggcgccgtagcaacttcatctcttttgggagttcctttgggacacaattcttcattccttcaagggcctgcatttgcacctcctcacattagggaagctatttggtgtggcagcacaaactcaacaactgaagaaggaaaggatttaagggatccacgagtgctagctagtgttggagatcttgctgtccaagaaattagagagtgtggagtagatgatcatcgattgatgaatgtagttagtgatgctgtcaagttagtcatggaagaggatccattacgtcccttggttttaggtggagatcactcaataacatatccaattgttagagctatctctgagaagcttggaggaccaattgaccttcttcattttgatgcacatcctgatctctatcatgaatttgaaggaaacttttattcccatgcttcttcgtttgctcgaatcatggagggcggctatgctcgtcgactcttgcaggttggtataagatcaataaattatgaagggcgtgaacaagcaaaaaaatttggagtagagcaatatgaaatgagaacatattcaaaggatcgcccctttttggagaacctgaaactaggagaaggtgttaaaggcgtttacatctcaatagatgtggattgtcttgatccagggtatgcaccaggagtgtctcaccatgaatcaggaggtctttctttccgagatgttatgaacgtcctgcaaaatcttcaaggcgatattgttggtggggatgtggtagagtacaacccacaacgtgatactgctgatgatatgaccgctatggtagctgctaagtttgtaagagaacttgctgcaaagatgtcaaaatgatgatgaatgtctagctttttcagagtgacatttagttttctctaagttttatttgaagtatcaataaaggagtgagtataggtgtaccgtacgtgtacgagtgagttctttagcctgaatgaaaacaagcttgcgcatcttcttttaatgcatgtacgccagaaaccataagatcagaacttgtaattctggtgattggtttcacttgtgccgttgtgcgcccatcatttgccatgtaacttgaatttctgaacaagaa

SEQ ID NO: 7 - DNA, 1357 bp, Arabidopsis thaliana
gcggccgccagtgtgagtaatttagaaactccgagtggccgaaacagagatttcgcagaggaaccatcactgattgtgtcaccgaaccattgatcttcaagttccgatccaatttcagatatgtcgaggattattggtagaaaagggattaactatatccatagactaaattctgcgtcgttcacgagcgtatctgcttcttcaatcgagaaagggcaaaatcgtgtgattgatgcttcgttaactcttattcgtgaaagggcaaaactcaaaggagagttagtgcgtcttttaggtggagctaaagcttcaacatctcttcttggtgtaccacttggtcacaactcttcttttcttcaaggtcctgcttttgctcctcctcgtattcgagaagctatttggtgtggtagcacaaactctgccactgaagaagggaaggagttgaaggatccacgggttctaactgatgttggggatgttccggtacaagagattagagattgtggggttgatgatgatagactgatgaatgtcataagtgaatctgtgaagttggtgatggaagaggaaccattgcgtccgttggtcttaggtggagaccattccatatcttatcctgttgtgagagcggtttctgagaagcttggagggcctgtggacattcttcatcttgatgcacatccggatatatatgactgttttgaaggaaataagtactctcatgcatcttcttttgctcgtatcatggaaggtggctatgcgcgtaggcttttacaggttgggatcagatcgataaaccaggaaggacgggaacaaggcaagaggtttggagtagaacagtatgagatgcgaaccttctcgaaagatcgcccaatgttggaaaatctgaaattaggggaaggagtgaagggggtatacatctcgatagacgttgactgtctcgatccggcatttgcacctggagtgtcgcatatcgaaccaggaggtctctctttccgtgacgtccttaacatcttacacaaccttcaggcagatgttgtcggggctgacgttgtcgagttcaacccgcagcgtgatactgttgacggcatgacagcaatggttgcagctaagcttgttagagaattagctgcgaaaatctcgaaatgaaacagaatggtaattttggagtttgttttttgttatgtttcatcgtgcaagtttgtaacattcatataggtacttgaatgcaataagtctggctcatagacggagtatcaaacaaacataatatgaattctgatctaaggctataaaatcaatgttcatatgcctaaaaaaaaaaaaaaaaaactaaattactcacactggcggccgc

SEQ ID NO: 8 - DNA, 1296 bp, Arabidopsis thaliana
accgagaaaactccgagtggccgaaacagagatttcgcagaggaaccatcactgattgtgtcaccgaaccattgatcttcaagttccgatccaatttcagatatgtcgaggattattggtagaaaagggattaactatatccatagactaaattctgcgtcgttcacgagcgtatctgcttcttcaatcgagaaagggcaaaatcgcgtgattgatgcttcgttaactcttattcgtgaaagggcaaaactcaaaggagagttagtgcgtcttttaggtggagctaaagcttcaacatctcttcttggtgtaccacttggtcacaactcttcttttcttcaaggtcctgcttttgctcctcctcgtattcgagaagctatttggtgtggtagcacaaactctgccactgaagaagggaaggagttgaaggatccacgggttctaactgatgttggggatgttccggtacaagagattagagattgtggggttgatgatgatagactgatgaatgtcataagtgaatctgtgaagttggtgatggaagaggaaccattgcgtccgttggtcttaggtggagaccattccatatcttatcctgttgtgagagcggtttctgagaagcttggagggcctgtggacattcttcatcttgatgcacatccggatatatatgactgttttgaaggaaataagtactctcatgcatcttcttttgctcgtatcatggaaggtggctatgcgcgtaggcttttacaggttgggatcagatcgataaaccaggaaggacgggaacaaggcaagaggtttggagtagaacagtatgagatgcgaaccttctcgaaagatcgcccaatgttggaaaatctgaaattaggggaaggagtgaagggggtatacatctcgatagacgttgactgtctcgatccggcatttgcacctggagtgtcgcatatcgaaccaggaggtctctctttccgtgacgtccttaacatcttacacaaccttcaggcagatgttgtcggggctgacgttgtcgagttcaacccgcagcgtgatactgttgacggcatgacagcaatggttgcagctaagcttgttagagaattagctgcgaaaatctcgaaatgaaacagaatggtaattttggagtttgttttttgttatgtttcatcgtgcaagtttgtaacattcatataggttcttgaatgcaataagtctggctccatagacggagtatcaaacaaacataatatgaattctgatctaaggctataaaatcaatgttcatatgcg

SEQ ID NO: 9 - DNA, 1276 bp, Arabidopsis thaliana
acttatacctcactgacttactacaaatcagatatgtggaagattgggcagagaggagttccctatttccagagactcattgctgcgccgttcacgaccttgcggtccttgccaacttctttggtcgagacagggcagaaccgtgtcattgatgcttcgttaactctcatccgtgaaagggcaaaactcaaaggagagttagtgcgactcataggaggagcaaaagctacaacagctcttcttggagtaccacttggtcacaactcttcttttcttgaaggcccagccttggctcctactcatgtaagggaagctatttggtgtggtagtacaaactccaccactgaagaagggaaggagctaaaagatccacgtgttctaagtgatgttggggatattccggtacaagagattagagaaatgggggttgatgatgatagacttatgaatgtagtaagtgaatctgtgaagctggttatggaagaggaaccattgcgcccgctggtcataggtggagaccattccatatcttatcctgttgtgagagctgtttcggagaaacttggaggacccgtggatattcttcatcttgatgcacatcccgatatatatgaccgttttgaaggcaattattactctcatgcatcttcttttgctcgtatcatggaaggtggctatgcgcggcggcttttacaggttgggatcagatccataaacaaagaaggacgggaacaaggcaagaggtttggagtagaacagtatgagatgcgaaccttctcaaaagatcgccaaatgttggaaaacttgaaactaggggaaggagtgaagggcgtgtatatctcgatcgatgttgactgtctcgatccgggattcgcgcacggagtgtcccacttcgaaccaggaggtctttctttccgagacgtccttaacatattacacaaccttcagggagatttggtgggggctgatgttgttgggtacaatccacagcgtgataccgctgatgacatgacggcaatggtcgcggctaagtttgttagagagctagccgcaaaaatgtcaaaatgaatttaaatggtactttggagtttaatcgttgaagcttgtaatatgcaataagtgtggtctcatagacatggtatcgaataagcttaatatcaattgggtttttaggcccaaatatcaatgtataatttattaaattatgataagatgcattgtaataagttgtaaaaataatttatcatattgcaatatatgtaaacattaatttagc

SEQ ID NO: 10 - DNA, 1324 bp, Glycine max
gtgaccccaatatacttagccatatctttacttcccaaaacttgctctacatgagtttccttcgttcttttgcaagaaacaaggatatatcaaaagtaggacgcagaggtatccattgcatgcagaaactatgtgcagaaaaaatatctcctgattcactagagaaggcccaaaatcgtgtgatagatgctgcactcacacttgttcgagaaaatacaggcttaagaaagaacttgtgtcatagtttgggaggtgctgtagcaacttcaactcttcttggagttcctttgggtcataattcatcgtttcttgaagggcctgcatttgcacctcctttcattagggaaggtatttggtgtggtagcgcaaactccacaactgaagaaggaaaggatttaaaggacttgcgaataatggttgatgttggtgatatccctattcaagaaatgcgagattgtgggataggagatgagagactcatgaaagttgttagtgattctgtcaaactagtgatggaagaggatccattacgtcccttaattttgggtggtgatccatcaatctcatatccagttgtcagagccatatctgagaagcttgggggaccagttgatgttcttcattttgatgcacatcctgatctctatgatgaatttgaaggaaattattattcgcacgcttcttcttttgctcgaatcatggagggtggttatgctcgtcgactcttgcaggtcggtataagatcaataaacaaagaagggcgtgaacaagccaaaaagttcggggtagagcagtttgaaatgcgacatttttcgaaagatcgtccatttttggaaaacctgaatctaggagaaggtgctaaaggagtatacatttcaatcgatgtggattgtcttgatccagggtatgctgtaggagtgtcccactatgaatcaggaggtctttctttcagggatgttatgaacatgctgcaaaatctcaaaggtgacattgttggtggagacgtggttgaatacaacccacaacgtgaacctcctgatcgtatgactgccatggtagctgctaagtttgtgagagaactcgctgcaaagatgtcaaaatgataactattaattctgcctcgtgtgtgtgacatttagtttacttcaatgcactcaacttttcaatttatagtgttgttgttatgaataaataatacatgcactattaccctgtttacactaacagtgtaaagatgatgtatgtgtataagactaagttttgtggtgttctattagaagtattaatcttgttaaaaaaaaatgtatttgtcatgtgaaggaaa

SEQ ID NO: 11 - DNA, 576 bp, Glycine max
ttctctttcaagttccaagaaatgtcaattataacacgcagaggcatccgttacatgccaagactagatgcagcaaaagtatctgctgctttgctagaaaaaggccaaaatcgtgtcatagatgcttcacttacacttattcgagaaagagcaaagcttaagggagaacttgtgcgtgctttgggaggtgctaaagcaacttcaactcttcttggagttcctttgggacataattcatcgttccttcaagggcctgcatttgcacctcctcgcattagggaggccatttggtgtggtagcaccaactcaacaactgaagaaggcaaggaattacaagatgcacgagtgctaactgatgttggtgatgttcctatccaggaaattcgagattgtggggtagatgatcacagattaatgaatgtaattggtgaatctgtaaagttagtgatggaggaggatccattatgtcccttagttttaggcggtgatcactcaatatcatttccagttatcagagctgtctctgagaagcttggaggaccagttgatgttcttcatcttgatgcgcatcctgat

SEQ ID NO: 12 - DNA, 1335 bp, Glycine max
acgagcagaagtgaccccaatatacttagccatatctttacttcccaaaacttgctctacaatgagtttccttcgttcttttgcaagaaacaaggatatatcaaaagtaggacgcagaggtatccattgcatgcagaaactatgtgcagaaaaaatatctcctgattcactagagaaggcccaaaatcgtgtgatagatgctgcactcacacttgttcgagaaaatacaaggcttaagaaagaacttgtgcatagtttgggaggtgctgtagcaacttcaactcttcttggagttcctttgggtcataattcatcgtttcttgaagggcctgcatttgcacctcctttcattagggaaggtatttggtgtggtagcgcaaactccacaactgaagaaggaaaggatttaaaggacttgcgaataatggttgatgttggtgatatccctattcaagaaatgcgagattgtgggataggagatgagagactcatgaaagttgttagtgattctgtcaaactagtgatggaagaggatccattacgtcccttaattttgggtggtgatcactcaatctcatatccagttgtcagagccatatctgagaagcttgggggaccagttgatgttcttcattttgatgcacatcctgatctctatgatgaatttgaaggaaattattattcgcacgcttcttcttttgctcgaatcatggagggtggttatgctcgtcgactcttgcaggtcggtataagatcaataaacaaagaagggcgtgaacaagccaaaaagttcggggtagagcagtttgaaatgcgacatttttcgaaagatcgtccatttttggaaaacctgaatctaggagaaggtgctaaaggagtatacatttcaatcgatgtggattgtcttgatccagggtatgctgtaggagtgtcccactatgaatcaggaggtctttctttcagggatgttatgaacatgctgcaaaatctcaaaggtgacattgttggtggagacgtggttgaatacaacccacaacgtgacactcctgatcgtatgactgccatggtagctgctaagtttgtgagagaactcgctgcaaagatgtcaaaatgataactattaattctgcctcgtgtgtgtgacatttagtttacttcaatgcactcaacttttcaatttatagtgttgttgttatgaataaataatacatgcactattaccctgtttacactaacagtgtaaagatgatgtatgtgtataagactaagttttgtggtgttctattagaagtattaatcttgttaaaaaaaaatgtatttgtcatgtgaaggaaa

SEQ ID NO: 13 - DNA, 995 bp, Glycine max
gacggtttccgctgttctcttttaagttccaagaaatgtcaattataacacgcagaggcatccgttacatgccaagactagatgcagcaaaagtatctgctgctttgctagaaaaaggccaaaatcgtgtcatagatgcttcacttacacttattcgagaaagagcaaagcttaagggagaacttgtgcgtgctttgggaggtgctaaagcaacttcaactcttcttggagttcctttgggacataattcatcgttccttcaagggcctgcatttgcacctcctcgcattagggaggccatttggtgtggtagcaccaactcaacaactgaagaaggcaaggaattacaagatgcacgagtgctaactgatgttggtgatgttcctatccaggaaattcgagattgtggggtagatgatcacagattaatgaatgtaattggtgaatctgtaaagttagtgatggaggaggatccattatgtcccttagttttaggcggtgatcactcaatatcatttccagatatcagagctgtctctgagaagcttggaggaccagttgatgttcttcatcttgatgcgcatcctgataactatgatgcctttgaaggaaacatttattcacatgcttcttcttttgctcgagtcatggagggtgactatgttcgacgtctcttgcaggttggtattagatcaataacagctgaagggcgtgcacaagccaaaaaatttggtgttgagcaatatgaaatgcgaacattttcaagggatcgcccctttctagagaacctgaaactaggggaaggtgttaaaggtgtatatatctcaatagatgtggattgtctcgatcccgcctttgctccaggagtgtctcacatagagccaggaggtctttctttccgtgatgttctcaacatcctgcacaatcttcaaggcgctgttgttgctggagacgtggtcgaattgaacccgcaacgtgataccgatgatggaatg

SEQ ID NO: 14 - DNA, 1004 bp, Brassica napus
atgtcgaggattattggtagaaaagggattaactatatccatagactaaattctgcgtcgttcacgagcgtatctgcttcttcaatcgagaaagggcaaaatcgtgtgattgatgcttcgttaactcttattcgtgaaagggcaaaactcaaaggagagttagtgcgtcttttaggtggagctaaagcttcaacatctcttcttggtgtaccacttggtcacaactcttcttttcttcaaggtcctgcttttgctcctcctcgtattcgagaagctatttggtgtggtagcacaaactctgccactgaagaaggaaaggagttgaaggatccccgggttctaactgatgttggggatgttccggtacaagagattatagattgtggggttgatgatgatagactgatgaatgtcataagtgaatctgtgaagttggtgatggaagagaaaccattgcgtccgttggtcttaggtggagaccattccatatcttatcctgttgtgagagcggtttctgagaagcttggagggcctgtggacattcttcatcttgatgcacatccggatatatatgactgttttgaaggaaataagtactctcatgcatcttcttttgctcgtatcatggaaggtggctatgcgcgtaggcttttacaggttgggatcagatcgataaaccaggaaggacgggaacaaggcaagaggtttggagtagaacagtatgagatgcgaaccttctcgaaagatcgcccaatgttggaaaatctgaaattaggggaaggagtgaagggggtatacatctcgatagacgttgactgtctcgatccggcatttgcacctggagtgtcgcatatcgaaccaggaggtctctctttccgtgacgtccttaacatcttacacaaccttcaggcagatgttgtcggggctgacgttgtcgagttcaacccgcagcgtgatactgttgacggcatgacagcaatggttgcagctaagcttgttagaga

SEQ ID NO: 15 - DNA, 1366 bp, Pinus taeda
ggcacgaggagcaatggggtccatgggaaaaatggtgatgaggtttctgcagaagcgtagtttggcaactttaccatcacaaatgatagagaagggccaaaaccgtgttgtggaagcttcccttaccctgatcagggagagagcaaaactcaaggcagaattggtgcaggcattgggaggctcaattgcaacgacttgccttctaggagttcctttggggcacaattcatctttccttcaaggccctgcattcgctcctcctcgcattcgagaagctatttggtgtggtagtacaaattccgcgactgagaaagggaaagaattgaaagactcgagagtgctgtcagatgctggagatgttccaattcaagaaatgcgagattgtgggattgaagatgagaggttaatgaaaactgtcagtgactctgtaaaaattgtaatggaggagcctccacttcgtccattggttttaggtggcgatcattcaatatcctacccagttgttaaggctgttacagaccaccttggagggccagtggatattcttcatttagatgctcatcctgatatttatgatgcttttgaaggaaataagtattcacatgcttcttcatttgcgcgaattatggagggtggtcatgcaaggcgacttttgcaagtgggcatcaggtctataacaaaggaaggtcgggagcaagggaaaagatttggagtagaacaatatgaaatgcacagtttcagtaaagatcgtgatttcttggagaatctgaaacttggggaaggtgtgaaaggcgtttatatctcaattgatgtggattgccttgatccggcatttgcacctggagtctcgcacctggaaccgggtggtctctcttttcgtggtgtcatgaaccttgtacaaaatttgcaaggagacattgtggcggctgatgttgtggaatttaatccacaacgtgacacagttgatggaatgacagcaatggttgctgcaaagcttgtaagagagctgacgtcaaagatgtctaagttggctcattgaaagcagccatgatctattctgtttcatgatacatgagatctgtaacaggaggaagttctacaattttgtgtgtacttgagagaataaaggcctccatgttagggttcttctttgtagaagtgactgaagaatatcaaaagcctcagtccatggatgcatcaattttgaactatcctgtgaatgcttgacataaataagtgaatgatcaggctcttcttggatagtttcaaattatttcgtttgtctattcatttgttcaaatttatttaatgagtaaatgcttcaatcaattggtttctggtgattaaaaaaaaaaaaaaataaaaa

SEQ ID NO: 16 - DNA, 1074 bp, Populus euphratica
  misc_feature (934)..(934): n is a, c, g, or t
  misc_feature (968)..(968): n is a, c, g, or t
  misc_feature (979)..(979): n is a, c, g, or t
  misc_feature (998)..(998): n is a, c, g, or t
  misc_feature (1025)..(1025): n is a, c, g, or t
  misc_feature (1028)..(1028): n is a, c, g, or t
  misc_feature (1051)..(1051): n is a, c, g, or t
gcgtccgcatcattatccaaaatccagcacagctttcttcccttcctctaaaacggccactcctctctatgcgagcgccaatcccctttcaccgttcaatcgctaattgctgttccctccctccgtctgctgttcatctaatccctcactctctctttctctctacaagatatgtcaattatagggaagagagggattcattacttgcaaaaactaaaaactgcaaatatccctcccgaattgctagaaaaaggccaaaatcgcgttatcgatgcttctctcacgcttattcgcgagcgtgctaagcttaagggagagcttttgcgcgcattaggaggtgttaaagcatcctcaacgcttcttggagttcctttgggacacaattcatcgtttcttcaaggaccggcgtttgctcctccgcgtatcagggaagcgatttggtgtggcagcacgaattcgagcacggaagaaggtaaagaattaaatgatccacgagtgctaacagatgttggtgatgttccggttcaagaaattcgagattgtggtgtggacgatgatagactgatgaatgttattagtgaatcagtcaagctcgtgatggaagaggatccattgcgtccgttagtcttaggtggtgaccactccatatcttttcctgtggttagagctgtctctgagaagcttggaggtcctgtagatattcttcatctagatgcccatcctgacatctatcattgctttgaaggaaataagtattctcatgcatcttcgtttgcccggattatggagggtggttatgctctcggcttttgcaagtgggtatcagatcaataacaaaagaagggcgtgagcaaggtaaacgttttggagtagagcaatatgaaatgccaaccttctcaagggatcggcagctattggaaaaatctgaaactanggggaaggtgtaaaaggtgtgtatatctccatanatgtggactgncttgatcctgcctttgctncctggcgtatcacatattgagccaggnggncttttctttccctaatgttctcnacattcttcacaaccttcaacct

SEQ ID NO: 17 - DNA, 775 bp, Picea glauca
  misc_feature (1)..(1): n is a, c, g, or t
  misc_feature (4)..(4): n is a, c, g, or t
  misc_feature (12)..(12): n is a, c, g, or t
  misc_feature (14)..(15): n is a, c, g, or t
  misc_feature (39)..(39): n is a, c, g, or t
  misc_feature (43)..(47): n is a, c, g, or t
  misc_feature (109)..(111): n is a, c, g, or t
nttntgcgggcngnnacagagcagcttggagggcctgtngatnnnnntcatttagatgctcatcctgatatttatcattcttttgaaggaaacaagtattcacatgctnnntcatttgcacgaattatggagggtggtcatgcaaggcgacttttgcaagtgggcatcaggtctataacaaaggaaggtcgggagcaaggtaaaagatttggagtagaacaatacgaaatgcacagtttcagtaaagatcgtgaattcttggagaatctgaaacttggggaaggtgtaaaaggcgtttatatctcaattgatgtggattgccttgaccctgcttttgcacctggagtctcgcatctggagccaggtggtctctcttttcgtgatgtcatgaacattgtgcaaaatctgcaaggagacattgttgcagctgatgttgtagaatttaacccacagcgtgacacagttgatggaatgacagcaatggttgctgcaaagcttgtaagagaactgacgtcaaagatgtccaagttagctgattgaaagcagccgtgatctattctatttcatgatacatgagatctgtaacaggaggaagttcttcaattttgtgagtacttcagagaataaaggcatgtctattgtcagggttcttttgagtagaaatgactgaagaatatcaaaagacccagtgaatggaaaacatcaattttgaactatcctgtgaatgcttgatatgaataaatgaaggatcaggctcttcttgaatagtttctaa

SEQ ID NO: 18 - DNA, 335 bp, Lactuca sativa
aggcctctcattccgagatgttctcaacattctccacaatcttcaagccgatgttgttggtgcagatgtggttgagttcaacccacaacgtgatactgttgatgggatgactggcatggttgctgctaaattggtcagagagttgactgcaaaaatatctaaatgaagaaaccacttttcttggtttatcattaaaaataaatattaatgatgtagcttcatttgagttattccgttggtttatttcctgtttaaatcatatctgaagaactcaagttgatcatagtgaaaaccatctttactaatttagctaatgttaacaaactaaacgacat

SEQ ID NO: 19 - DNA, 1427 bp, Cabernet sauvignon
ctgcatgctatgtagctcatataatcatcttcttcttcaatcgccactctattcgtcacagggaagagtccccatttcttgatttgttatagttcagtctcactcaggtatgaggaatattgcaaggaagggaattcattactggcagaaactgaatgctgcaaatgtcccagctgagttgatagaaaatggccaaaatcgtgttatagatgcttcccttactcttattcgtgagagggcgaagcttaagggggagcttgtgcgagctttaggtggtgctttagcctcatcatctcttcttggagttcctctaggacataattcatcattccttcaagggccagcctttgctcctcctcgtataagggaggcaatctggtgtggcagcacaaacgccacaaccgaagaagggaaagaattaaatgatccacgggtgcttactgatgttggtgatgtccctgtccaagagataagagattgtggtgtagatgatgacaggttgatgaaaattataagtgagtctgtcaagctagtgatggaagaagatccattgcgcccattagttttaggtggtgaccactcaatatcatttcctgttgtaagggctgtgtctgagaagattgggggtcctgtagatattcttcacctggatgcccatcctgacatttatcattcctttgaaggaaacaagtattcacatgcatctccctttgcccggatcatggagggtggttatgctcgacggcttttgcaagttggtcttcgatccattacaagtgaaggccgtgaacaaggcaagagattcggtgtggagcaatatgaaatgagaacgttttcaagagatcgacacattttggagaacctgaaactaggggaaggcgtgaagggtgtatacatttcattagatgtggactgtcttgatcctgcatttgctcctggggtatctcatattgagccaggaggtctttctttccgcgatgttctcaacatcctccacaacctgcaagccgatgttgttgccgctgatgtggttgagttcaatccgcaacgtgacacagtggatgggatgactgcaatggttgctgccaagctggtaagagaactgactgctaagatgtcaaaaatgaagaactagtgtgccctctctgtgggagttaatcatatttttcaatttacgacttactgttctagcataaccagatttcttcatctttcggtttctttgaagcatttctgaaggaattaaaatgtatacctgcctggctctcagtggcttgggaaacttttatagagcagttatttccttggaatagtattgtacttcatctcatggaaggaatcagcatatataagaataaacaatgtcatcaattttaattgttatatgaacatcttcaaagttgcattatgagggaatgttttggtgg

SEQ ID NO: 20 - DNA, 884 bp, Saccharum officinarum
acgtctcctctgtcctctccccgcctgcctcttgcgtcctccgcctcttttcctgctcgctggcagccgcggtgtccgatcgagagggagagtgagcccgaggggagagggcttagtcgggctccgccttgggagaggaccaagagatgggcggcgcggcggcgggtaccaagtggatccaccacatccagcgcctcagcgcggtgaaggtgtcggcggaggcggtggaacggggccagagccgcgtcatcgacgcctccctcaccctcatccgcgagcgcgcaaagctcaaggcagagttgctacgtgctctgggtggcgtgaaagcttcagcgtcgctcttaggggtccctcttggtcacaactcgtcctttttgcaaggccctgcatttgctcctccacgcataagggaggccatttggtgtggaagcacaaattctagcacagaggaaggcaaagaattgaatgatcctcgggtgctaactgatgttggtgatgtccccattcaagagatccgtgactgtggcgttgaagatgacagattgatgcatgtaattagtgagtctgttaaaacagtgatggaggaggagcctcttcgaccgttggtgttaggaggcgatcactcgatatcttatccagtggttagagctgtgtctgaaaagcttggaggacctgttgacattcttcatcttgatgcacatccagatatctatgattgttttgaagggaacacttattcacatgcctcttcatttgctagaattatggaaggtggttatgccaggagactgctacaggttggattgagatcaattaccaaagaaggccgtgagcaagggaagagatttggtgtggaacaatatgagatgcgaaccttctcaaag

SEQ ID NO: 21 - DNA, 1297 bp, Gossypium raimondii
gttcatacaaggcacgcaagcaacgaaacctgcccattgcttctttccatgtccaattcccctgtttcttactcaataacctaaagcttttaagtttcttcttcatcttcaagtttaagacatgtcgagctcgggggtagtgcgaagaggaattcattatttgcaaaagctaaaagccgcgaatataccttctgatttgatagaaaagggccaaaatcgtgttatcgatgcttctcttacccttattcgggagagggcaaagctcaagggagaacttgtgcgtgctttgggcggtgctttagcatcaacatcactgcttggagttcctttaggacataattcatcgtttcttcaaggacccgcttttgctcctcctcgtattcgggaggctatctggtgtggcagcactaactcagccactgaagaaggcaaggaactaaatgatccacgggtgctaactgatgttggtgatgtccctgtccaagaaatacgtgattgtggtgtagatgatgatagattgatgagtgtcataagtgaatctgtcaagctagtaatggaggaggatccgttacgcccattagttttaggcggtgaccactcgatatcctttcctgttgtaagagcggtctctgagaagcttggtggacctgttgatatacttcatttagatgcccatcctgatatttacgattgttttgaaggaaataagtattcacatgcatcttcttttgctcgaattatggagggtggttatgctaggcggcttttgcaggtcggtatcagatcgataacaactgaagggcgcgaacaaggaaaaaggttcggagtggagcaatacgaaatgcgaacattttcaaaagactgtcatttcttggaaaacctgaaactaggggaaggagtaaagggtgtgtatatttcagtagatgtggactgtcttgatccagcctttgccccgggggtatctcacatcgaaccgggaggcctttcctttcgtgatgttctcaatatcctacccaatcttgaaggaaatctggttgctgccgatgtagtagagttcaatccccaacgtgaccccgtcgatggaatgactgcaatggttgctgctaagcttgtaagagaactggctgctaagatgtcaaaatgataagttgtcttaaatttctatgttaaggtctttggatgtttcatttctatttagcttaaacttatgacaatgctactggcaatcttatagctaaataagatttatattgtttagactcttcctttttttctgaaatattcaagagatgagatg

SEQ ID NO: 22 - DNA, 1467 bp, Sorghum bicolor
acgtgtgggttacgtgagagtgaagaagagccgccggcaacgccgccgcggcacgtctcctccagctgcctcttgcgtcctccgccgcctcttttcctgctcgctggcagccgcggatccatcgagaatcgagagttggggggggggagagtgagcccgaggggagagggctctagtcgggttccgccgaagagatgggcggcgcggcggcgggtaccaagtggatccaccacatccagcgcctcagcgcggcgaaggtgtcgacggaggcggtggagcggggccagagccgcgtcatcgacgcctcactcaccctcatccgcgagcgcgcaaagctcaaggcagagttgctgcgtgctctgggtggcgtgaaagcttcagcgtcgctcttaggggtccctcttggtcacaactcatcctttttacaaggccctgcatttgctcctccacgcataagggaggccatttggtgtggaagcacaaactctagcacagaggaaggcaaagaattgaatgatcctcgggtgctaactgatgttggagatgtccccattcaagagatccgtgactgtggcgtcgaagatgacagattgatgcatgtaattagtgagtctgtcaaaacagtgatggaggaggagcctcttcgaccgttggtgttaggaggcgatcactcgatatcttatccagtggttagagctgtgtctgaaaagcttggaggacctgttgacattcttcatcttgatgcacatccagatatctatgactgttttgaagggaacacttattcacatgcctcttcatttgccagaataatggaaggtggttatgccaggagactgctacaggttggattgagatcaattaccaaagaagggcgtgagcaagggaagagatttggtgtggaacagtatgagatgcgaaccttctcaaaggaccgagagaagcttgagaatctgaaacttggggaaggtgtaaagggagtgtatgtctcagttgatgtggactgccttgacccagcgtttgctcccggtgtctctcacattgagccaggaggcctctcgttccgcgatgtgctcaacatcctccagaatttgcagggtgacgttgtcgccgccgatgtggtggagttcaacccacagcgtgacacggtggatgggatgacagccatggtcgccgcgaaactggtccgggagctcactgctaagatttccaagtgagacggtcaggatcacaccattcttcgtgaagcaatgtgaaagtgtggattttgatgtctcggtggtttcttggtcttggttcatttgtatcgagcaccaaacgcttcgacatgtgacaaagcttatgttaatgttaacaacgtaaagttgttttctcctactcctatttagatcattctagatgcttaccatgtatttagggtggggattatgaaaccaaacatgccagattctagaacaaatgctccga

SEQ ID NO: 23 - DNA, 1528 bp, Zea mays
ccacgcgtccgcagagattcgaagaagacacaaataaaatctcgccaaattcatgaactctctagtctctactctcttctcctggcaacgatttccaaacgcacgcaaacgctgtcacagtttgtcacggcagcggcaagtcggcaacgctgccgcggcacgtctcctccctctcttttccggttcgggtagtcgggtgtaccgccattcgtgatcgaaccagactcgagagggagaggaggagggagtccgaggggagagacccaattagctgcagggattggtcgggttcggctccgccttcggagagtcccaagagatgggtggcgcggcggcgggtaccaagtggatccaccacatccagcgcctcagcgcggccaaggtgtcggcggaggcggtggagcggggccagagccgcgtcatcgacgcctccctcaccctaattcgcgagcgcgcaaagctcaaggcagagttgctgcgtgctctgggtggcgtgaaagcttcagcgtcgctcttaggggtccctcttggtcacaactcatcctttttacaaggccctgcatttgctcctccacgcatacgggaggccatttggtgtggaagcacaaactctagcacagaggaaggcaaagaattgaatgatcctcgggtgctaactgatgttggagatgtccccattcacgagatccgtgactgtggtgtcgaagatgacagattaatgcatgtaattagtgagtctgtcaaaacagtgatggaggaggagcctcttcgaccgttggtgttaggaggcgatcattcaatatcttatccagtggttagagctgtgtctgaaaagcttggaggacctgttgacatacttcatcttgatgcacatccagatatctatgattgttttgaagggaacacttattcgcatgcctcgtcatttgccagaataatggaaggtggttatgccaggagactgctacaggttggattgagatcaatcaccaaagaagggcgtgaacaagggaagagatttggtgtggaacagtatgagatgcgaaccttctcaaaggaccgagagaagcttgagaatctgaaacttggggaaggcgtaaagggtgtgtatgtctcagttgatgtggactgccttgacccagcgtttgctcctggggtctctcacatcgaacctggaggcctctccttccgcaatgtcctcaacatcctccagaatttgcagggtgacgttgtcgccgctgatgtggtggagttcaacccacagcgtgacacggtagatgggatgacagccatggtcgccgcgaagctggttcgggagctcactgctaagatctccaagtgaaacggtcaggattgcaccactcttcttgaagcaaagcgaaagggtgggttttgatgtcccggtggttattggtcatggtttctatgtatcgagcaccaaattgttcgacatgtgacaggtttatatgttaattaggttgcaataacaccataatggtttatttaaaaaaaaaaaaaaaaaaaaaaa

SEQ ID NO: 24 - DNA, 1369 bp, Hordeum vulgare
cggcacgagggtgcatttcactctcttggtattacgttacgtctcttccttccttcttcagttccccacaggcgagaggccgctccgctcgcttgccttcctccttcccacccctcgacgattcctcggcgatgggcggcgcggcggcggcggcgtcgggcgccgccaggtggatccagcggctgagcgcggccaggatctcgacggaggcgctggagcggggccagagccgcgtcatcgacgcctccctcaccctcatccgcgagcgcgccaagctcaagggagagttgctgcgcgctatgggtggtgtgaaagcttctgcgacactcttgggagtaccccttgggcacaactcatctttcttgcaggggcctgcatttgctcctcctcgcataagggaggccatttggtgtggaagcaccaactctagcacagaagaaggcaaggaattaaatgatccaagagtgctaactgatgttggtgatgtccctatacaagagattcgtgactgtggtgttgaagatgacagattgatgcatgtaatcagcgattctgtcaaaactgtgatggacgaagatcctcttcggccgttggtcttaggaggcgatcactcgatatcttatccagttgttagggctgtgtctgaaaagcttggcggacctgttgacattcttcatcttgacgcacatccagatatctatgattgttttgaagggaacacttactcacacgcttcttcatttgcaagaataatggaaggaggttatgcgaggcgacttttgcaggttggacttagatcaattaccaaggaaggacgtgagcaagggaagagatttggtgtggaacagtatgagatgcgcaccttctccagagatcgggagaagcttgagaatctgaaacttggggaaggtgtgaagggggtgtatgtctccgtcgacgtggactgccttgaccccgcattcgctcctggtgtctctcatatcgagccgggaggcctctcgtttcgcgacgtgctcaacatcctccagaatctgcaaggtgatgtcgtcgccggagatgtggtggagttcaacccacagcgcgacacggtcgacgggatgacggctatggtcgccgcaaagctggtccgggagctgagcgccaagatctcaaaatgaggagagccctggccagtcaggacataagcagcaaagaggattttcaggcacaatggtccttgaccttagttcctgccaatcatttgtgccacattttagtctgacaatcttctataaataataaaatcaggctgcaaaaacgtctttgaatttggtatgtgctatgtggtacttgttggttctcctttcacatgcacgcatccaagattaat

SEQ ID NO: 25 - DNA, 1401 bp, Triticum aestivum
gccgcttcgctcgtttgcttctctcgccgtctcctcctccagtcctcctccccagttcccaccccctcgacgattcctcggcgatgggcggcgcggcggcggcggcgggcgccgccaggtggatccagcggctgagcgcggccaggatctcgacggaggcgctggagcggggccagagccgcgtcatcgacgcctccctcaccctcatccgcgagcgcgccaagctcaagggagagttgctgcgtgctatgggtggtgtcaaagcttctgcgacactcttaggagtaccccttgggcacaactcatctttcttgcaggggcctgcatttgcgcctcctcgcataagggaggccatttggtgtggaagcaccaactctagcacagaagaaggcaaagaattaaatgatccaagagtgctaactgatgttggtgatgtccccatacaagagattcgtgactgtggtgttgaagatgacagattgatgcatgtaatcagcgagtctgtcaaaacagtgatggacgaagaccctcttcggccgttggtcttaggaggcgatcactcgatatcttatccagttgttagggctgtgtctgaaaagcttggcggacctgttgacattcttcatcttgacgcacatccagatatctatgactgttttgaaggcaacacttactcacacgcttcttcatttgcaagaataatggaaggaggttatgcgaggcgacttttgcaggttggacttagatcaattaccaaagaaggacgtgagcaagggaagagatttggtgtggaacagtatgagatgcgcaccttctccagagatcgggagaagcttgagaatctgaaacttggggaaggtgtgaagggggtgtatgtctccgttgacgtggactgcctcgaccccgcattcgctcctggcgtgtctcatatcgagccgggaggcctctcatttcgcgacgtgctcaacatcctccagaatctgcaaggcgatgtcgtcgccggagatgtggtggagttcaacccgcagcgcgacacggtcgacgggatgacggctatggtcgccgcgaagctggtccgggagctgagcgccaagatctcaaaatgagcagcgacagtcaggacagaggcagcagcagagaggattttcaggcacagtggtcgttgatcttagttcctgccaatcattcagttgtgccacgttttagtctgacaatcttctataaataataaaatcaggctgcaaaacgacttcgaatttggtatgtgctctgtggtatttgttggttctcctttcacatgcacgcatccaagattaagctcgtaggtgcctagtagtcgataagaacatcgtctctcacgcaaaggatatgttgaaaaatctgaaatgaatttgaaaaatc

SEQ ID NO: 26 - DNA, 1521 bp, Oryza sativa
gcatgtgtggtaccgggaatcggcattatggcggggggggcggtgcactgcattattgttgcctcgctcgctcgatcgatcccctctcctctccaaatcccatccccaaatcccgaatcctccatcgagatcgatcgacgtcgagcggagcgaaggggggatatgggcggcgtggcggcgggcaccaggtggatccaccacgtccggcggctcagcgccgccaaggtgtcggcggacgccctggagcgcggccagagccgggtcatcgacgcctccctcaccctcatccgcgagcgcgccaagctcaaggcagagttgctgcgcgctcttggtggtgtgaaagcttcagcatgcctcttaggtgttcctcttggtcacaactcatcgttcttacagggacctgcatttgctcctccccggataagggaagccatttggtgtggaagtaccaactctagcacagaagaaggcaaagaactcaatgatcctcgagtgctaacagatgttggtgatgtccccatacaagagattcgtgactgtggtgttgaagatgacagattgatgaatgttgtaagcgagtctgtcaaaacagtgatggaggaagatcctcttcggccattggtcctgggaggcgatcactcaatatcttatccagttgttagggctgtgtctgaaaagcttggtggacctgttgacattcttcaccttgacgcacatccagatatctacgatgcttttgaaggaaacatctattcgcatgcttcttcatttgcaagaataatggaaggaggttatgctaggaggcttctacaggttggaatcagatcaattaccaaagaagggcgtgagcaggggaagagatttggtgtggaacagtatgagatgcgcactttttcaaaagatagggagaagcttgaaagtctgaaacttggggaaggtgtgaagggagtgtacatctcagttgacgtggactgcctcgatcccgctttcgcgccaggtgtctctcacattgagccaggaggcctctccttccgcgacgtgctcaacatcctccataacctgcaaggagatgttgtcgccggagatgtggtggagttcaacccgcagcgtgacacggtggacgggatgacggctatggttgcagccaagctggtccgggagctcacagccaagatctccaagtgagcatccattcagattcagggcatatcatatcaccaaccaaccccttgagtctgaagcagcaaagaggatgattcccagactcctttagctgttagtctaggttcctatgtagtagacatcagctatgccagattttgtatgtgacagtcatttatatactcattaggttgcaataatgtttgcctccattttgcacttgtgatgttatggttatccctcatcatcgtgtgctagaagaatgcatatgaaccgtttttgtcgtgctttcaggcaacatgctgacgacaaaaatgcttggccaataagagtaataaattattggcattttaaagacag

SEQ ID NO: 27 - DNA, 1013 bp, Oryza sativa
tggcggcgggcaccaggtggatccaccacgtccggcggctcagcgccgccaaggtgtcggcggacgccctggagcgcggccagagccgggtcatcgacgcctccctcaccctcatccgcgagcgcgccaagctcaaggcagagttgctgcgcgctcttggtggtgtgaaagcttcagcatgcctcttaggtgttcctcttggtcacaactcatcgttcttacagggacctgcatttgctcctccccggataagggaagccatttggtgtggaagtaccaactctagcacagaagaaggcaaagaactcaatgatcctcgagtgctaacagatgttggtgatgtccccatacaagagattcgtgactgtggtgttgaagatgacagattgatgaatgttgtaagcgagtctgtcaaaacagtgatggaggaagatcctcttcggccattggtcctgggaggcgatcactcaatatcttatccagttgttagggctgtgtctgaaaagcttggtggacctgttgacattcttcaccttgacgcacatccagatatctacgatgcttttgaaggaaacatctattcgcatgcttcttcatttgcaagaataatggaaggaggttatgctaggaggcttctacaggttggaatcagatcaattaccaaagaagggcgtgagcaggggaagagatttggtgtggaacagtatgagatgcgcactttttcaaaagatagggagaagcttgaaagtctgaaacttggggaaggtgtgaagggagtgtacatctcagttgacgtggactgcctcgatcccgctttcgcgccaggtgtctctcacattgagccaggaggcctctccttccgcgacgtgctcaacatcctccataacctgcaaggagatgttgtcgccggagatgtggtggagttcaacccgcagcgtgacacggtggacgggatgacggctatggttgcagccaagctggtccgggagctcacagccaagatctccaagtga

SEQ ID NO: 28 - DNA, 1074 bp, Populus euphratica; identical to SEQ ID NO: 16
  misc_feature (934)..(934): n is a, c, g, or t
  misc_feature (968)..(968): n is a, c, g, or t
  misc_feature (979)..(979): n is a, c, g, or t
  misc_feature (998)..(998): n is a, c, g, or t
  misc_feature (1025)..(1025): n is a, c, g, or t
  misc_feature (1028)..(1028): n is a, c, g, or t
  misc_feature (1051)..(1051): n is a, c, g, or t

SEQ ID NO: 29 - DNA, 928 bp, Mesembryanthemum crystallinum
  misc_feature (883)..(883): n is a, c, g, or t
agcacgagctcaatctcacgaatcaatcagtcatgcagaatattgcaaggaggggaatccattacttatcgaaattgaatgctgcaaacgttccttctgatttgattgaaaaaggtcaaaaccgagtgatagatgcctctctcaccctcattcctgagagagcaaagcttaagggggagcttgcgcgggccttatgaggcgccaaagcatcatcatcactcattggagtccctctagggcataattcatcatttcttcagggtcctgcatttgcacctccacgtattagggaagcaatttggtgtggaagtacaaactcatcaactgaagaaggcaaggacttaagtgacccacgagtcctaacagatgttggtgatgttcctgttcaagagatcagagattgtggagtgaatgatgacagattgatgagcattatcagtgagtcagttaagcttgtcatggaagaagatcctttgcggcctttagttattaggtggtgatcattcaatattttacccggttgtaagagctgtctcttgaaagctaggaggacccgtagatattttgcatcttgaagctcaatcccgatattatcatgccctttgaggggaacaagtattcccaggcatctttttttgcccctataatggaaggtggcttttgtgggagggttttgcaagctggttttaagatctataaatacctgcaaggtccagagcaacggaaaaaaatttggtgttggggcacatttaaaatgggaacatttttcaagaagaacgcccattattttgtgaaaactttgaaacttcggcaagggggttgaaagtggggaaccaatataaaataaagtaggaacgtgttctgaatccttcaattttcaccncgtgtttattctaaaacatgagacccggacggccatgtattttct

SEQ ID NO: 30 - DNA, 823 bp, Allium cepa
aaacaaaagacttctgctcccgtacgtcttctaccttctctgctctttttatgaactacacgtatgaattcaatttgccataattctgtctgtacaaggaatatttgtttttactagaattgcggaaggaagatgagcactcacgcaataaaatggatccaatctttgaagagaatgagcacgggaaatctaccggccgagattatagagaaagggcaaaatcgggttatcgaggcctctcttactctcatccgagaaagagccaagcttaagggagaattattacgagcactgggaggtgctaaagcttcagcaacactactgggggttcctttaggccacaattcttcatttttacaaggtcctgcctttgcgcctcccaggattagggaagctatatggtgtggtagcacaaactctgctaccgaagagggcaaggatttaaaagattctcgcatattgaccgatgttggcgacgtaccaattcaagagattcgggattgtggtgtagatgacgatagattaatgaatataatcagtgaatctgtgaaattggtgatggaagaacatccacttcgtccattggtgttgggtggagatcactcaatatcataccctgtagttagagctgtagcagaaaaacttggaggacctgtggatatccttcacttagatgcacatccagatatctacgatgcatttgaaggaaataaatactcacatgcttcttcctttgcgaagataatggaaggaggtcatgccaggcgcccttttacaagttggaataagggtcaattactgatgaaggacgggaacaagggaa

SEQ ID NO: 31 - DNA, 708 bp, Capsicum annuum
ggtggttatgctcgccggctttgccaagtgggaattagatcaattaataaagaaggtcgggaacaaggaaaaaggtttggtgtggagcaatatgaaatgcggacattttcccgagaccgcgaatatttggagaatctgaaacttggagaaggtgtgaagggcgtgtatatctccgtggatctcgactgtatggatccagcatttgctcctggggtatctcatatagagccagggggtctctctttccgtgatgttttaaacatactgcataaccttcaagctgatgttgttggtgctgatgtcgttgagttcaacccacagcgcgacactgttgatggcatgactgcaatggttgctgcgaagctggtaagagaacttactgccaagatatccaagtggcctgcagtaattccaaatttatgaaggacacagaccatgcgtcaaatggagaacgctagatttatactcatccttactggaaagtttgacggaggataagcaccaacaaagtgtttattcaccttattgtagcactaaagcacattaggacttaaaattaaagtattagataggtctggtagacgctcagtttcctattgcaagatcgaattactcaatggggaatattatttcatgtcattgattggattatctgccaacttgtttcccaaaataagctatctctgcagttccttatgtttgtgtatg

SEQ ID NO: 32 - DNA, 552 bp, Theobroma cacao
  misc_feature (4)..(4): n is a, c, g, or t
  misc_feature (124)..(124): n is a, c, g, or t
  misc_feature (531)..(531): n is a, c, g, or t
cccngcctctgatcttccttttccaagaaaacctccaattcttcgcctttcattgcgaacatgtcagccatagggccggagcagaggaattcattatttgcagaaactgagtgctgcaaatatnccttctgatttgatcgaaaagggccagagtcgtgtaatagatgcttctctcacccttattcgcgagaaggcaaagctcaagggtgagcttgtgcgtgctttaggaggttctttagcatccacttctctgcttggagttcccttaggacataactcgtcgtttcttcaaggaccggcgtttgctcttcctcgaattagggaggcaatgtggtgtggtagcacgaactcatccactgaagaagggaaggaactaaaggatcctcgggtgctaactgatgttggtgacctcgctgtccaggagatccgtgattgtggcgtagatgatgatagattgatgaacgtcgtaagtgagtctgtcaagatagtaatggaggaggatccattacgcccattagttttaggtggtgnccactcaatatcttatcctgt

SEQ ID NO: 33 - DNA, 1310 bp, Medicago truncatula
tgaagatacattggatatacgtggaaaaaagacacattagcgaaataaatcctttataattagcgccactccactcgctctctctcctccataacgagtttcctctgttctctgccaactttcacagaaatgtcgacgatagcacgtagaggcatccattacatgcagagactgaattcggcaaatgtatcatctgctttgctagagaatggccaaaatcgtgtaattgacgcttcacttaccctgattagagaaagagcaaagcttaagggagaactcgtgcgtgctttgggaggtgctgttgcaacttcatcgcttcttggagttcctttgggtcataattcctcattccttcaagggcctgcatttgcacctcctcgcattagggaggccatttggtgtggtagtacaaactcgacaaccgaagaaggtaaggatttacaggacgcacgagtgctaactgatgttggtgatgtccctattcaagaaattcgagattgtggtgtagatgatcatagattgatgaatgtcattggtgaatctgtcaagttagtgatggaagaggatccgttaaggcccttagttttgggtggcgatcactcaatatcatttcccgttattagagccgtctctgagaagcttggaggaccggttgatgttcttcatcttgatgcacaccccgataactatgatgaatttgaaggaaactattattcacatgcttcttcttttgctcgagtcatggagggtaactatgttcggcgactcttgcaggttggtatacgttcaataacaactgaaggacgcgcacaagcaaaaaagtttggcgttgagcaatatgaaatgcgaacattttccagagatcgccacttcctagagaacctgaaactaggggaaggtgtgaaaggtgtatatatctcaatagatgtggattgtcttgatcctgcttttgctcctggagtgtctcacatagaaccaggaggtctttcattccgcgatgttcttaacatcctacacaatcttcaaggcgatgttgtggctggagatgtggttgaattcaacccacaacgcgatactgtcgatggaatgactgctatggtagctgctaagttggtgagagaattggctgcaaagattgcaaaatgataaatctcatgactccagatatttatttcctaaatacactttgaaggatacctttttagagttgcaatcaaattttactaggttgatgcattcttaaaagagtttatacaatatcaaacatgattaatctttcaaataattttgacatatttatcttgaggttt

SEQ ID NO: 34 - DNA, 1296 bp, Arabidopsis thaliana
tcaccgaaccattgatcttcaagttccgatccaatttcagatatgtcgaggattattggtaccgagaaaactccgagtggccgaaacagagatttcgcagaggaaccatcactgattgtgtcttcaatcgagaaagggcaaaatcgcgtgattgatgcttcgttaactcttattcgtgaaagaaaagggattaactatatccatagactaaattctgcgtcgttcacgagcgtatctgctcttcttggtgtaccacttggtcacaactcttcttttcttcaaggtcctgcttttgctcctagggcaaaactcaaaggagagttagtgcgtcttttaggtggagctaaagcttcaacatctgagttgaaggatccacgggttctaactgatgttggggatgttccggtacaagagattagacctcgtattcgagaagctatttggtgtggtagcacaaactctgccactgaagaagggaagatggaagaggaaccattgcgtccgttggtcttaggtggagaccattccatatcttatcctgattgtggggttgatgatgatagactgatgaatgtcataagtgaatctgtgaagttggtggttgtgagagcggtttctgagaagcttggagggcctgtggacattcttcatcttgatgcacatccggatatatatgactgttttgaaggaaataagtactctcatgcatcttcttttgctcgtatcatggaaggtggctatgcgcgtaggcttttacaggttgggatcagatcgataaaccaggaaggacgggaacaaggcaagaggtttggagtagaacagtatgagatgcgaaccttctcgaaagatcgcccaatgttggaaaatctgaaattaggggaaggagtgaagggggtatacatctcgatagacgttgactgtctcgatccggcatttgcacctggagtgtcgcatatcgaaccaggaggtctctctttccgtgacgtccttaacatcttacacaaccttcaggcagatgttgtcggggctgacgttgtcgagttcaacccgcagcgtgatactgttgacggcatgacagcaatggttgcagctaagcttgttagagaattagctgcgaaaatctcgaaatgaaacagaatggtaattttggagtttgttttttgttatgtttcatcgtgcaagtttgtaacattcatataggttcttgaatgcaataagtctggctccatagacggagtatcaaacaaacataatatgaattctgatctaaggctataaaatcaatgttcatatgcg

SEQ ID NO: 35 - DNA, 1276 bp, Arabidopsis thaliana; identical to SEQ ID NO: 9

SEQ ID NO: 36 - DNA, 1269 bp, Drosophila melanogaster
gtcgttgttgtctcattcattcccggcctcgcagtcgtggattttacagcattgcgagcagatccaatctaagagatcctagatcacatgcaaaatgtggtggagccgtaaatttgcctcaaggtctctccgcctccaccggctcaagagcaccggaagcactgcgcccagggaacctgagcaatctctaggcatcattggagtgcccttcgcaaaggggcaggccaagcagggcgtggaactggcgccagatcttctccggcagagcagtctgcgtcaggtgcttcagagcagtcatgatggcctggtgatacgggactacggaaatctgcagtacgccgtagacgagccccttctccagcagcagcgtgtgcactatcaccacatccgaaactacgcggacttcatggcctgcaatcgggcactgattgaacaggtgaaactcatgctcgtggagaacacgcagtttttagccattggtggtgatcatgcgatcggcttcggatccgtggccgggcacctgcaacacacgccgaatttgtccctggtgtggatcgacgcacatgcggacatcaatctgcatagcacctcgcagtcgggcaacatccatgggatgcctgtatcctttctgttggaacagctccgtaacacctggcagcacgctggcctccaggaaatcgcgcccaactgcttgcccaaggatcagctggtttacatcggactccgggacattgacccctacgaggcgttcatcctaaacaaagtcggaatacgctactatgcaatggataccatcgaccgggtgggcgtgcccaagattatcgagatgacgctggacgcccttaatccgcagaacaagatccacgtcagctttgacatcgacgccttggacagcaatgtggcgcctagcactggcaccgcggtgcgcggtggcctcacgctccgcgagggaatcagcatcgtggaggcactccgggacaccaagcgggtgcagggcgtcgatctggtggagatcaacccaaagctaggcagcgagcgcgacgtgcgcaccactgtggagtccggcctggagatactgaagagcatgttcggttaccggcgttcggggcgctggagcaacatcgataccggaatccttggtagcgattaaagaatgcaacacccccagttttgaacttattcatatttatgtacagcattcgtgacatattagtgtgtgtttttttttcgtatcttaatgagagaatacaatatttgcgtaaaaaagaa

SEQ ID NO: 37 - DNA, 1952 bp, Danio rerio
tagaagccgcaccgggagacagactgagttgttagtttgggaaaaaccttctgttttgcgtcagtaaattattttataattatccagtcagcatggcgatgagaggaccactgtccagactactgaaatccaccttgacttcctgccagcagaacagatcacattctgttgccattttgggagctccgttttccaaaggacagaaaaggagaggggtggagcatggacccaaagctattcgggatgcaggtctggtggaaagactttcaaatcttgactaccctgttcatgatttcggagacctgaccttcaagcatctggaaaaagatgagcacttcatgcacgtgccgttcccacgcacagttggacgtgccaatcagttgctctctggagctgtgagtggggcggtgggagcaggacacacttgcatcatgctggggggagatcacagcttagcgattggctcagtggaaggccattctcagcagtgtcctgacctgtgtctgatatgggtggacgcacatgcggatatcaacacgcctctgacttcaccttcgggaaacctccacggccagtctgtagctttcttactaaaggacctgcagaacaagatgcccaaagttcccggattttcctggatgaagccgttcctgtctgccagagatctggtgtacattggtcttagagatgtggatccaggcgagcatgtattcctaaagaccctgggaattcagtacttctccatgcgggacattgacagaatgggcattcagagagtaatggaggtcactctggatcacctcttggcaaggaagcaaaggccgatccacctgagctttgacattgatgcttttgacccatcgctggctcctgccactggaactccagttaacggcggactgacctacagagagggcatctacataacagaggagatccacaacacaggtttgctgtctgtgatggatgtggttgaagtgaaccccacactcggagcggcacctgaggctgtggaagccacgactagtctagccgttgacatagttgcatccgctctgggccagacgcgtgaaggcgcacacgtctccttcccgaagattacagaaccaaaagaagacactgagctgcggctgtagagcacacgatcatcctcatcaaagactctgacaaacaaaccactttgcattccaaagtctaaaagaacaacactgaaggatttgcagagactgatcaccaggctaaaggtttattatgaagggttactgtagtcttgagctataaatgatacatttttaaaaaaatgtgacctcactggaaaagtgctgctttgagcagaatggtgagatttattatattacgtctgctactaattttaggtttgtgttaaaaatgactgctgagatctggattctatatatttgagggctgaacagtacatgtttttaatgtttcgtcagctgtcatgggattagtgggtaacctcggatcactctctgggtattactgcaggaaaaaatgacataaaagaaagtatctgaaggatgaggtgacgctttactttggactgtttttcctctggattgaaacatgtttgcacttttggaccagaactggtttttattgtatttctatatgtctgttggttttgtatagtaggactgctttaatggctaatctaatcctgtgggtttggttaggttgagactcttttttttaaatagtttgtttgaagtaagttattttagtaagtttaatttttatttaaataaaaaaaatcatgtatgaatgcaattcatgcatctttttcagatctgaattcaccaccagtaccggtatcttcctaataagggtagcttgatttgttgcatttcaatgttccactaaaactgttttgttgcaataaactaatgtactggagacagaaaaaaaaaaaaaaaaaaaaaaaaaaaaaa

SEQ ID NO: 38 - DNA, 1714 bp, Xenopus laevis
cttacaatgagtagccaaggaaagacatcagttggagtcattggagccccattctccaagggacagccaagaagaggagtggaagaggggcctaaatatttaagagaggccgggttaattgagaaattaagagaatttggcaatgatgttcgagattgtggggatttggattttcctgatgtgcctaatgacacaccatttaacaatgtgaaaaacccacgtacagttgggaaagctacagaaatattggccaatgctgtcacagcagtaaagaaagctgacaagacatgcctaaccattgggggagatcacagcttggcagtgggaacgattgccggtcacgcagcagttcaccctaatctctgtgttgtgtgggtggatgcccatgcagatatcaacactccgtccacatcacccagtggcaaccttcatggacagccgttatcttttttaatgaaagaactcaaaagcaagatgccggctgttccaggatttgagtgggtgaaaccatgtctccgtagcaaagacattgtatacatcggcttaagagatgtggacccaggagagcattacattctgaagacacttggtataaaatactattcaatgtctgaagtggattatcttaaaatagacaaagtaatggaagagacacttgaatatttggttggcaagcataagagacccattcatttaagttttgacattgatggactggacccaagcatagccccagctactggaacccctgtgcctggaggactgacttacagggaaggcatgtacatcacagaacaacttcacaaaacaggtttactttcagcagtggacattatggaggtgaacccatcgcgcggagaaactaagcgagacgttgaggtcacagttaaaactgctcttgatatgactttgtcatgctttgggaaagcacgcgaaggatttcatgcatcgaccatgatgcttccagatattttctaattacacaatattgtatatagcaagtgtacaaataaagcactcgggatgaagcacacaatttgactagtcccattttaaaaaaaaatgcattttacaccttcaaaaacaaatatgatttaaaggggatgtacagcttaaaattaacatatgatacgattgttcagatacagttgtccattatatttggaaatgatctatctgctgcttttgcaatgttcaaagtctacaactgaggtttggaattcgctagattcccagttaccataacaatttattatttatctctgacgaatcctcattttctctgctggcatatacagccaatcaagccttctacacctcatatgtattttgcactggcgcccactgtatcagcctgcatcaaattttggtatcaaaatctgctcagaacgagtgtctgtcaatacacagatatacatacatacatacatacatgggattggaaggcagctgattggcttctcctgtgtgccattagacacatataggttaaatagtagccagaacatgctttactttttgttaaatatgaaattgcatatttttaaaaatcaatatgattatattaagctggcaaggcagtgttttcacattagtacaattatctctgctttaaatgaaatgtgactcctaaggaatgtgtaatttactctgaagctgtgtaaattctatatttttaataaacatttatgttgaaataaaaaaaaaaaaaaaa

SEQ ID NO: 39 - DNA, 1511 bp, Gallus gallus
cggacgcgtgggcggacgcgtgggcggcagggtgacacagtgagccgcctggctgtgttcccagctgcagggacggggcaggctttggggtctcgctgtgtgtgtggcaggatgatttgtctgctcaggacagccaggctctctgctcggttgctttttgcatccgctgccgctccgtgccgccgtgcctcgcggttcaacgtgcctcccagtgctgagttcgtggcccggcccgtgggggtctgctccatgctgaggcttcctgttcagacttcagcagaggggctggatgcggcttttgtcggcgttccccttgacacgggcacatccaaccggcctggagccaggttcggtccgcagcagatccgtgctgagtcagtgatggtgaggaggtacaacgccagcaccggggcagcgccctttgactccctgctggtggccgatgttggagatgtaaatgtcaacctctacaacctgcccgacagctgccgccgcatccgtgagtcctaccagaagatcgtggcctctggctgcgtgcctctcactctgggtggagaccacagcataacataccccatcctgcaggcagtggcagaaaagcatggccctgtggggctggtgcatgtggacgctcacactgacaccagcgacatggctctgggggagaagatctaccatgggaccccattccggcgctgcgtggatgaagggctgctggactgcagccgtgtggttcagattggaatccgtggctcctcctatgcccccaatccatacaagtactgctgggaccagggattccgggtggttccagctgaggagtgctggatgaagtccctggttccactgatgggagaggtgaggcagcagatgggggatggcccagtgtacatcagctttgatatcgatgggctggaccccgcctacgccccgggaacggggacaccagagattgctgggctcacacccatgcaggctttggagattattcgtggctgcaaaggactcaatatagtgggatgtgaccttgtggaggtggcacccatatatgatgtctctggtaacactgccctgttaggggccaatctgctctttgaaatgttgtgtgtccttcctggagtgaaaacaatgtgagggcagctcctgcctggcccccaaccttgcacagcagtgtaccgccaccagcagatgccatcacagaccttggatgaggttcctgatgccctgctctcctccaggtgcagtgatcgtgtgctttgcagtaaggaataaatgctgctaggagaggtagtgaagcacagcagctggggagagctgggtgtcctttggcccagccgttggtgttccaggaggggtttggttgcccttgggatgtgtgagttggtgcagacacggggtctatatttggcacatggaaacacaaaagccacctcatcacacattaaaatagtttatttcggttgaaaaaaaaaaaaaaaaaaaaaaaaaaaaaaaaaaaaaaaaaaaaaaaa

SEQ ID NO: 40 - DNA, 1386 bp, Rattus norvegicus
ctcagctgcaggaaccctggatgagcatgagctccaagccaaagcccatagagattatcggagcgcctttctctaagggacagcctcgaggaggggtagagaaaggtcccgcagcattaaggaaagctggcctggtggagaagcttaaagaaacagagtacaatgtgagagaccacggggatctggcctttgtggatgtccccaatgacagcccctttcaaattgtgaagaacccacggtctgtgggaaaagccaatgaacagctggctgctgtggtagcagagacccagaagaatggaacaatcagtgtggtgctgggtggagaccacagtatggcaattggaagcatctctggccacgccagggtccaccctgacctatgcgtcatttgggtggatgctcacactgacatcaacactccgctgacaaccagctctgggaatctgcacgggcaaccggtggcctttctcctgaaggaactgaaaggaaagttcccagatgtaccaggattctcctgggtgaccccctgcatatctgccaaggacatcgtgtacatcggcttgcgagatgtggaccctggggaacactatataataaaaactctgggcattaagtatttctcaatgactgaagtggacaagctgggaattggcaaagtgatggaagagaccttcagctacctgctgggaaggaagaaaaggcccattcacctgagttttgatgttgatggactggacccagtattcaccccggctacgggcacacccgttgtgggaggcctatcttacagagaaggtctctacatcacagaagaaatttacaagacagggctactttcaggactagatatcatggaagtgaacccaactcttgggaagacaccagaggaggtgactcgtactgtgaacacggcagtgccgttgaccttgtcttgttttggaacgaaacgggaaggtaatcataagccagagactgactaccttaaaccaccgaaataaatgtgaatacatcgcataaaagtcatctggggcatcacagcaaaccgaacagaaccaggccaacgctgctcctcccaagggcttgttcttttagaaaaaagaatgttttttcccaatatgtatgtattctagcagttcctttctggaatgaaattcagggtgtgggaattaaaacagctatgaaattaggagacacgtacttcccattttagcagaagttatccttaagaagtagtataaattaatatctaattaaaaaatgcaccaggagttaaaatacacagtgatgtcaagtgtcaactcacggttggaagcaaaggcatctggagacgaggcctgcatccacgtcgttcaaaacatgtgatttttgtaataaactctttataat

SEQ ID NO: 41 - DNA, 1463 bp, Rattus norvegicus
cgcgcttgcctagtgaagctgcgaacgtgtgggaggctgcactcactcgaggtcctgagttgcgcggagctgcttctgctagggcgatcgcctccctgcaatcatgttcctgaggagcagcgtctcccgtctcctccacgggcaaattccttgtgccctgacgagatccgtccactctgtagctgtagtcggagcccctttctctcggggacagaaaaagaaaggagtggaatatggcccagccgccatccgagaagctggcttgctgaagaggctttctatgttgggatgccatataaaagactttggagacttgagttttactaacgttcccaaagatgatccctacaataatctggtcgtgtatcctcgctcagtgggcattgccaaccaggaactggctgaggtggttagtagagctgtgtcaggtggctacagctgtgtcacactgggaggagaccacagcctggcaatcggtaccattagtggccatgcccgacaccacccagatctctgtgtcatctgggttgatgctcatgctgacattaatacacccctcaccactgtatcaggaaatatccatgggcagcctctttcctttctcatcagagaactacaagacaaggtaccacaactgccaggattttcctggatcaaaccttgcctctctcccccaaatcttgtatacattggcttacgagatgtggagcctgccgaacactttattttaaagagttttgacatccagtatttctccatgagagatattgatcgacttggtatccagaaggtcatggaacagacatttgatcggctgattggcaagaggaagaggccgatccacctgagctttgacatagatgcatttgaccctaagctggctccagccacaggaacccctgtggtaggggggctgacctacagagaaggactgtacattactgaagaaatacatagcacagggttgctgtcggctctggatcttgttgaagtcaatcctcatttggccacttctgaggaagaggccaaggctacagccagcctagcagtggatgtgattgcttcaagttttggtcagacaagagaaggcggacacattgcctatgaccaccttcctactcctagttcaccacatgaatcagaaaaggaagaatgtgtgagaatttaggaaacactgtactctggcacctttcacgacagcattccagagttgggaggcatttaaagggacaaagagtaaatggctgtctggatccaatattgccttaatgagaacatctgtgcactctcacaagtgtagagtccccttctctattttggtcacaatactatcactgtaaatgtatctgttgggtttttgtttctgaagtttacaagctattgttattatacacgtgtgtttgaaggagtcataaacagcatttattaccttaaaaaaaaaaaaaaaaaaaaaaaaaaaaaaa

SEQ ID NO: 42 - DNA, 1198 bp, Mus musculus
tgattataaggggggaaaaagatgtgccctctgtcttttagggttacggccggtggagagcagctggacagcccgagcatatgcagcagcagcagccactggaacccagagagagcatgagctccaagccaaagtccttagagattatcggagcgcctttctcaaaaggacagcctcgaggaggggtagagaaaggccctgcagcactgaggaaagctggtcttctggaaaaacttaaagaaacagagtatgacgtgagagaccacggggacctggcctttgttgatgtccctaatgacagctcctttcaaattgtgaagaacccacggtctgtggggaaagccaatgaagagctggctggtgtggtggcagaggtccagaagaatggaagagtcagtgtggtgctgggtggagaccacagtctggcagttggaagcatctctggccacgccagggtccaccctgacctatgtgtcatttgggtggatgctcacactgacatcaacactcccctgacaaccagctctgggaatctgcatgggcaacctgtgtcctttctcctgaaggaactgaaaggaaagttcccagatgtaccaggattctcctgggtgactccctgcatatctgccaaagacatcgtgtacattggcttgcgagacgtagaccctggggaacactatataataaaaactctgggaattaagtatttctccatgactgaagtagacaagctggggattggcaaggtgatggaagagaccttcagctacctgctgggaaggaagaaaaggccgattcacctgagctttgatgtcgacgggctggacccagcattcaccccggcgaccggcaccccggttctgggaggcctatcttacagagaaggtctctacatcacagaagaaatttacaagacagggctcctttcaggactagatatcatggaagtgaacccaactcttgggaagacagcagaggaggtgaagagtactgtgaacacggcagtggctttaaccttggcttgtttcggaactcaacgggagggtaaccataagccagggactgactaccttaaaccacctaagtgactgtgaatgcgccacatgaaaaccatctggggcatcacagcaaagcagacagagctaagcaaacgccttctcctcccaagggcttgttcttttagaaaaaaaaaaaaaaa

SEQ ID NO: 43 - DNA, 1396 bp, Mus musculus
gttgcaccgagccggttctcctagggtaatcccctccctgccaatcatgttcctgaggagcagcgcctcccgtctcctccacgggcaaattccttgcgtcctgacgagatccgtccactctgtagctatagtcggagcccctttctctcggggacagaagaagctaggagtggaatatggtccagctgccattcgagaagctggcttgctgaagaggctctccaggttgggatgccacctaaaagactttggagacttgagttttactaatgtcccacaagataatccctacaataatctggttgtgtatcctcgttcagtgggccttgccaaccaggaactggctgaagtggttagtagagctgtgtcaggtggctacagctgtgtcaccatgggaggagaccacagcctggcaataggtaccattatcggtcacgcccggcaccgcccagatctctgtgtcatctgggttgatgctcatgcggacattaatacacctctcaccactgtatctggaaatatacatggacagccactttcctttctcatcaaagaactacaagacaaggtaccacaactgccaggattttcctggatcaaaccttgcctctctcccccaaatattgtgtacattggcctgagagatgtggagcctcctgaacattttattttaaagaattatgacatccagtatttttccatgagagagattgatcgacttgggatccagaaggtgatggaacagacatttgatcggctgattggcaaaaggcagaggccaatccacctgagttttgatattgatgcatttgaccctaaattggctccagccacaggaacccctgttgtagggggattaacctacagagaaggagtgtatattactgaagaaatacataatacagggttgctgtcagctctggatcttgttgaagtcaatcctcatttggccacttctgaggaagaggccaaggcaacagccagactagcagtggatgtgattgcttcaagttttggtcagacaagagaaggaggacacattgtctatgaccaccttcctactcctagttcaccacacgaatcagaaaatgaagaatgtgtgagaatttaggaaatactgtactctggcacctttcacaacagcattccagagttgcaaggcattcgaagggacagatatgaaatggctgtctggatcaatattgccttaatgagaacatctgtgcactctcacaactgtaaaactcccttctctattttggtcaccaacactattactgtaaatgtattttttgttgtttttgaagtttacaagctattaatgttatacatgtaagtttgaaggagtcataaacaacatttattaccttagtatatcataaaaaaaaaaaaaaaa

SEQ ID NO: 44 - DNA, 1427 bp, Sus scrofa
ccacgcgtccgcggactcatggtcattccaggtatgaacttgctgggcttccacctgactgtgtcttccgttcagtaggtggagccactcttcctcattagaataaagtcaacagattgaactcaattataaataggaaaaaaaatgtgcccttggccactgagtgttgctgagagggaagactggctggaggactctggtgtagcggtgagaaatattggagcatgagtttcaagtcacaatccatcgggatcatcggagctcctttctccaagggtcagccacgaggaggggtggaagaaggccctacagcattgagaaaggctggtctgcttgagaaacttaaagaacaagagtgtgatgtgaaagattacggggacctgtgctttgctgatgtccctaatgacactccctttcaaatagtgaagaatccaaggtctgtgggaaaagcaaatcaacagctggctgatgtggtggcagaaatcaagaagaacggaaggaccagccttgtactgggcggagaccacagtatggcgattggcagcatctctggccatgccagggtccacccagatctctgtgtcatttgggtggatgctcacaccgacatcaacactccactgacaaccacgaccgggaacttacatggacagcctgtgtcttttctcctgaaggaactaaaggaaaagattcccgaggtcccaggactttcctgggtgactccctgcctatctgccaaagatattgtgtatattggcctgagagacgtggaccctgcagaacactatattttgaaaactctgggcattaaatacttttcaatgattgaagtggataagctgggaattggcaaggtgatggaagaagcattcagctatctactaggaagaaagaaaaggccaattcatttgagctttgatgtggatggactggatccatttttcacaccggccactggcacaccagtccatggaggtctgtcttatagagaaggtatctacatcacggaagaaatttacaaaacagggctactgtcaggattagatatcatggaagtgaatccatctctggggaagacaccagaagaagtaactcggacggtgaacacggcagtagcactggtcttggcttgttttggagttgctcgggagggtaaccataagcctattgattacctgaaaccacctaagtaaatggaaacattacatgaaaatctcacagctgatgacataattagcaaatctaacagtttagttaaacttacagttatcttcccgattggactttcagaaaaatgttttgccctggtaaatatgagtaccattagtataaactgtatcaattccctcttggtgtgaaaatcaagatatggaactgctagcttttgtgaaattaaaaaacttattattcccaaaaaaaaaaaaaaa

SEQ ID NO: 45 - DNA, 1445 bp, Homo sapiens
tcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcacaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaag

SEQ ID NO: 46 - DNA, 1354 bp, Homo sapiens
gattctcagtgctgcggatcatgtccctaaggggcagcctctcgcgtctcctccagacgcgagtgcattccatcctgaagaaatccgtccactccgtggctgtgataggagccccgttctcacaagggcagaaaagaaaaggagtggagcatggtcccgctgccataagagaagctggcttgatgaaaaggctctccagtttgggctgccacctaaaagactttggagatttgagttttactccagtccccaaagatgatctctacaacaacctgatagtgaatccacgctcagtgggtcttgccaaccaggaactggctgaggtggttagcagagctgtgtcagatggctacagctgtgtcacactgggaggagaccacagcctggcaatcggtaccattagtggccatgcccgacactgcccagacctttgtgttgtctgggttgatgcccatgctgacatcaacacaccccttaccacttcatcaggaaatctccatggacagccagtttcatttctcctcagagaactacaggataaggtaccacaactcccaggattttcctggatcaaaccttgtatctcttctgcaagtattgtgtatattggtctgagagacgtggaccctcctgaacattttattttaaagaactatgatatccagtatttttccatgagagatattgatcgacttggtatccagaaggtcatggaacgaacatttgatctgctgattggcaagagacaaagaccaatccatttgagttttgatattgatgcatttgaccctacactggctccagccacaggaactcctgttgtcgggggactaacctatcgagaaggcatgtatattgctgaggaaatacacaatacagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatttacacattctcacaattgtaaagtttcccctctattttggtgaccaatactactgtaaatgtatttggttttttgcagttcacagggtattaatatgctatagtactatgtaaatttaaagaagtcataaacagcatttattaccttggtatatc

SEQ ID NO: 47 - DNA, 1082 bp, Saccharomyces cerevisiae
  misc_feature (1058)..(1058): n is a, c, g, or t
atggaaacaggacctcattacaactactacaaaaatcgcgaattgtccatcgttctggctccattcagcggcggtcagggtaagcttggtgtcgagaagggccctaaatacatgcttaagcatggtctgcaaacaagcatagaggatttgggctggtctacggaattagagccctcaatggacgaggcccaatttgtgggaaagttgaaaatggagaaggactccacaactgggggttcctctgttatgatagacggtgtcaaggctaaaagagcagatttggttggtgaagccaccaagttggtgtacaactccgtgtcgaaagtggtccaggcgaacagattccccttgaccttgggtggtgatcattcaatagccattggtactgtatccgcggttttggacaaataccccgatgctggtcttttatggatagacgcccacgctgatataaacaccatagaaagcaccccctctggaaacttgcacggctgtcccgtgtcattcctaatgggtttgaacaaggatgtcccacattgtcccgagtcgctcaaatgggttccaggcaacttgagcccaaaaaagatcgcgtatattgggttgagagatgttgatgccggagaaaagaaaatcttgaaagatctgggtatcgccgccttttccatgtaccacgttgacaaatacggcatcaacgctgtcattgaaatggcaatgaaagccgtgcacccagaaacaaacggtgaaggtcccattatgtgctcctatgacgtcgatggtgtagacccattatacattcctgctacaggtactccagtgagaggtgggttgaccttgagagaaggtcttttcttggtggaaagattggccgaatccggtaatttaattgcgctagacgttgttgaatgtaaccctgatctggctattcatgatatccatgtttcaaacaccatctctgcaggttgcgccattgcaaggtgtgcattgggtgaaaccttattgtagtttatatcatcatcccttttatcaaaataagcattctctttttattttagttaagnacatgcatacataaatttacgaac

SEQ ID NO: 48 - DNA, 1090 bp, Agrobacterium faciens
gtcgacacatgagtgatcgttcggccatcgcaactgtgcggtgaccaaagttgcagtcaagaaatgaacggtgctggcgaaatcaacgcttcgcggcatcgcaaggagaatgagttgaagacgtgccaaatcctgggagctcccgttcaaagtggcgcatcccaacccggatgcctgatgggacctgatgcgtttcggactgccggcttgacgcaagttctgacggagctgggctgggctgtcaccgatctcggagatgcgacaccaacggtcgaacccgaactcagccaccccaattccgcggtgaagaacctcgatgctctggtgggatggacgcgcagtctgtcccagaaagctctggagatggcccgcagctgcgatcttccggtctttctcggcggcgatcactcgatgtctgctggcaccgtctcaggtgtggcccaacgtacagccgagcttggcaaggagcaattcgtcctttggctggacgcgcatacggacctgcataccctccacacgaccgcgagcggcaatctccacggcacacccgtagcctactatacgggccaatccggcttcgaagggctgccgccgctggccgcgcctgtaaatccccgcaacgtatccatgatggggattcgctcagtcgatccggaagagaggcgacgggttgccgagatcggtgttcaagtcgctgacatgcgggttctggacgaacaaggggtcgtacgcccgctcgaagcttttcttgaccgcgtgagtaaggtcagcggcagattgcacgtcagccttgatgtcgatttcctcgatcccgcgatcgcgccagcagtgggcacgaccgttcctggcggagcgaccttccgggaagcgcacctcatcatggagatgctccatgacagcggccttgtcacgtcactcgacctggcggagctcaatccgtttctggatgagagggggcgcactgcccgcctcataaccgatcttgcctcgagcctattcggccggcgcgtgttcgacagggtgacaacagcattttgatcaccgggtgttgcccggtgcgatcgaggtttgcctctcgcaccgagacaaa

SEQ ID NO: 49 - DNA, 1297 bp, Schistosoma japonicum
acaagtaaaaatgttgaaatccgttgcaaccccttattatcctgttcaaaatggtgaaacacctaagcttttatatccacatgtcaatttcttgggtatacctgttaacaaagggcaaccaaaacttggtacatatcagggaccagattttattagaaaatctaacttcttccagcttgtagctgaagatggaatccaaataaccgactgtggagatgtcatacctgtagaactaagtgaatcagaggatccagaacgttgtggaatgaaatggtcaagaagtttcacacagaccactttgaaaatagctgaccgtgtagaacagttggtaaaagggtcaaataaacatagtattgaatccagtaattcgaaaccatcaccattagtaattgttggcggtgatcatagtatggcgactggaactatacttggacatgctagagccaaaccagatgtgtgcattatatgggttgatgctcatggtgatataaatacaccaccaaactcaactactggaaatatacatggaatgccgttaagttttctagtaaaagaactacaagatcaaattccatggttggatgactttcatagtataaaaccatgtctggatgccagcaatcttgtttacattggtttacgggatttagacgtttatgaaacacgggatataagaaagcatgctatagcttattttacaatgcttgacgttgatcgaatgggaatggaagccgtcattaaagaagcattacaagctgtgaatccgagattagagaaacctattcatttaagttttgatattgatgcattggatccttcaattgctccaagtactggtactgctgttccaggtggtttaacattacgtgaaggtttaagaatatgtgaagaaatttcagctacaggaaaactttctattgttgaattggctgaattaaatcctttgttaggatctaaagaggatgttgaaaaaacgcaatcatctgctgtgcacattttaagggcatcgttaggacattgtcgttcaggtcaattaccgatgaaagttaacaattcaaccactaataccattgttagacaagctgaacgtatacagataaagtgataattattctttcttcaatagcaattaattgatttaattcttataataatataattcaatgatcaatatgattaattaataatgttgctaacaaaataatatgtaataatacaatgatttaagtatttttctaaatatactactattattatatttgaaaagcaaaaaaaaaaaaaaaaaaaaaaaaaaaaa

SEQ ID NO: 50 - DNA, 990 bp, Leishmania mexicana
atggagcacgtgcagcagtacaagttctacaaggagaagaagatgagcattgtgcttgcccccttctccggcggccaaccgcacagtggggtagagctgggtcctgactacctcctcaagcagggactgcagcaggacatggagaagcttggatgggatacaaggctcgagagggtgttcgacggcaaggttgttgaggctcgcaaggcgagcgataatggcgacaggatcggtcgtgtcaagcgcccgaggctgacagcggagtgcacggagaagatctacaagtgtgtgcgcagggtggccgagcagggtcgctttcctctcaccatcggtggcgatcactccatcgccctcggcacggtggccggtgtgttgtccgtgcacccggatgccggggtgatttgggtggacgcccacgcggacatcaacactatgtctggcacggtctccggcaacttgcacggctgccccttatcgatcctgttggggcttgatcgcgagaacattcccgagtgcttttcgtgggtaccgcaggtgctgaagccgaacaagattgcctacattggtctgcgtgctgtggacgacgaggagaagaagatcctgcacgacctgaacatcgccgccttcagcatgcatcacgtggaccgctacggcatagacaaggtggtgtccatggcgatcgaagccgtctcgccgaagggtacggagccggtgatggtgtcatacgacgtggacacgatcgaccccctctacgtcccggcgacgggcactcccgtgcgtggcggcctctctttccgcgaggcgttgttcttgtgcgagcgtatcgccgagtgcggtcgtcttgtcgctctggacgtggtggagtgcaacccgctcctcgccgctacggaatcgcacgtgaacgacaccatctccgtcggctgcgccatcgcacgctgcatgatgggagagacacttctttacactccgcatacgagctccaagctatag

SEQ ID NO: 51 - DNA, 1912 bp, Saccharomyces cerevisiae
tgatttttacataccgtatatccaatttacggcccttcacatatagcggcgaaatgatggtaagctacgcatactgtctgacaggaccctattctagcaaccttacatgaaacaaaaacaaacaacatcacatcatacggatgaactacgggtgcaatccctgactcatcaatgtttatcataaacttagatatcaacactgataaaccccacctctatttttactggttcttcactttttcgatgccgcaccgtcgcccgcgatccccgccctttgattgctccttccattaacagtttttttctatcccttacaagaagccgagacgccgcgaaaatatcggctagtgcgaatagtctctagctcttgcccttcgcaaagcaccgtgctgctaatggcaatcaacagcgcatcgccgctcgctgaatttttcacttagcggtagccgccgaggggtctaaagagtatataagcagagcttgcggcccactttctatcaagatctaagactgtttctcttctcttggtctgtatatgttttctcaaagttagcagaaacaacaacaacaactatatcaataacaataactactatcaagatggaaacaggacctcattacaactactacaaaaatcgcgaattgtccatcgttctggctccattcagcggcggtcagggtaagcttggtgtcgagaagggccctaaatacatgcttaagcatggtctgcaaacaagcatagaggatttgggctggtctacggaattagagccctcaatggacgaggcccaatttgtgggaaagttgaaaatggagaaggactccacaactgggggttcctctgttatgatagacggtgtcaaggctaaaagagcagatttggttggtgaagccaccaagttggtgtacaactccgtgtcgaaagtggtccaggcgaacagattccccttgaccttgggtggtgatcattcaatagccattggtactgtatccgcggttttggacaaataccccgatgctggtcttttatggatagacgcccacgctgatataaacaccatagaaagcaccccctctggaaacttgcacggctgtcccgtgtcattcctaatgggtttgaacaaggatgtcccacattgtcccgagtcgctcaaatgggttccaggcaacttgagcccaaaaaagatcgcgtatattgggttgagagatgttgatgccggagaaaagaaaatcttgaaagatctgggtatcgccgccttttccatgtaccacgttgacaaatacggcatcaacgctgtcattgaaatggcaatgaaagccgtgcacccagaaacaaacggtgaaggtcccattatgtgctcctatgacgtcgatggtgtagacccattatacattcctgctacaggtactccagtgagaggtgggttgaccttgagagaaggtcttttcttggtggaaagattggccgaatccggtaatttaattgcgctagacgttgttgaatgtaaccctgatctggctattcatgatatccatgtttcaaacaccatctctgcaggttgcgccattgcaaggtgtgcattgggtgaaaccttattgtagtttatatcatcatcccttttatcaaaataagcattctctttttattttagttaagcacatgcatacataaatttacgaacaaaaaaagaaaataaattaaaataaaagtagtgtatcttcgttacttttcattctttttggttaacccacgtctaattgccaatacactatcgacgatcacggcatctacacctgcttcaatttgtatactggcattttcgggatcattgttgtccacaccgtaagtgacacataccagcccattagacttaaccacttgcaccaaccgtggggcctttaaaatgggtgc

SEQ ID NO: 52 - DNA, 1707 bp, Schizosaccharomyces pombe
gaattccgtagcttagtttcgatcttttccgttccatggtaaatatgacttgtttcaaaaaatggctatggaaaatatccccagagggttgggtgtatattatgattttacgtcctatttctattaattttccatagtgtgattttttcctttcttgaattactttatttttatttaatttattttctttgctttatttcatttcgtttgatttattttatttatttatttatttttttttttaataatagtgaaccgagctatcgttacggagtatagaaatgttgagtccgtggaattaatatcccgtttttaggttgatgagtctaatatgattgcccgcaagatctgataacggccggtagataaaatactcaaagactattgagtaagcaaacgctcactatttattaaagccgtcatcggcatgaaaaacggaattccataaatttcgcaacctcccatctacttcaaagggtcctttgctatacacaacatcgtttctacctgactgaatcaaaaatatatacaatgtctcctcataaaatacccgaagtacatagacatattatgtctagtagatacatggagggaaatgccgtctctatcataaatatgccattttcaggcggtcaacccaaggacggtgctgaattggctccagaaatgattgaggcggctggattgcctgaagacttggagcgtcttggttatagtgtcaacgtcgttcaaaatcccaaatttaaaagtcgacctttaaaagaaggccctaatcaagccctcatgaaaaacccactctacgttagcaatgttactcgccaagttcgtaatattgttcaacaggaactagagaagcaaaggatcgcggtcaacattggaggagatcattcacttgccattggcactgttgaaggtgtacaagctgtctacgatgatgcttgtgtcttgtggattgatgcccatgctgatattaatacccccgattcatccccttcaaagaatcttcatggctgcccattgtccttttccttgggatatgccgaacctcttcctgaagagtttgcttggacaagaagagtaattgaagagcgtcgtcttgcgttcatcggtttgcgcgatttggatcctatggaacgtgcttttcttcgtgaacgcagcatcactgcttacactatgcacgatgttgataaatatggaatagccagagtagtagaaatggcattggaacacatcaatccaggaaggagacgtcccattcatctttcttttgacgtcgatgcctgtgatccaattgtcgctccagctactggaacccgtgtgccaggcggtttgacctttcgtgaagcaatgtacatttgtgaaagtgttgcagaaactggctctctagttgctgttgatgttatggaagttaacccacttttaggcaacaaagaggaagccaagacaactgtggatttagctcgctctattgttcgaacttgtcttggtcaaacgttattgtagaaccatgtattttatgctatatcatgaattagaagtatgttacgcgtcggattagctactgtgctttttcaacgtcccaacacacaagtatattaataaactcaaaatctcataattcagacactgtaccgacaaacttgggcaaagttactgtttggttctcagatacttgactagactatttaagaaagaattttagttttt

SEQ ID NO: 53 - DNA, 7469 bp, Plasmodium yoelii
  misc_feature (55)..(55): n is a, c, g, or t
  misc_feature (7348)..(7349): n is a, c, g, or t
  misc_feature (7352)..(7354): n is a, c, g, or t
  misc_feature (7356)..(7357): n is a, c, g, or t
  misc_feature (7359)..(7359): n is a, c, g, or t
  misc_feature (7372)..(7372): n is a, c, g, or t
  misc_feature (7386)..(7386): n is a, c, g, or t
  misc_feature (7387)..(7387): n is a, c, g, or t
ccgaagcacatataatttacacattcttcaaaagcataaatatcatatatttatnttcttccttaatgtctccaattaagcacaatatgcatgcatatattcttttttccttttcatgcgctatgcattttttataagttttaaaaaaaattcgaagcatatcataatgatttagtgttatgtaaaatgatttagtattatgcagtaatgatttagtattatgtaataataatttgaaatataaaatttgctatatcaaattagttatatcaaattagctatgtcaaattagctatgtcaaattagctatgtcaaattagctatgtcaatttagctatataaaattagctatataaaattaaccataaaaatcagcaaaaattaataaaaaaagttttggaaaattataaaatgcggagcgacgaaactaataaagcaaacaaaccaatcgaattatctcctctagaaaataatgatgaacaaaataatgatgaacaaaataatgatgaacaaaataatgatgaacaaaataatgatgaacaaaatagtgatgaaattaacgagtttgaattagaagttgaagaagaagtcattaattacctatcttctctaatatataataaaaatgttaagcataagattgtgaaaataaataatttaatagacgaccaaatatataattatatagaaacttgtaatcatttaggtaatattactaatttaaataaagatccaaaagaagaaaatcaaaatataaaaacaaatcaaggaacattagatacctctcatatatccaacccaataaatgaagaaactagcaaatatacaattcattccaaaagtagcgataattttgatatcataaaaacaaatacattgccattattcttatcctcaaaattagatcaacaaaaagaagatcaaataaaatgcaatcaaaatgaaaaaaaatgcaaaaattttaaaagttgcactataataaatgagacaacaaatattacacttttatacaataaaaatgattcacaaacaaatgtgttatatgtatgttatgatgaagaaaatgatgaatgtgaaatatgtaatagttatagactgaagtatatgccaaatatgagcatgtttaaaaatgatagtaataacgataagggtaacgcaccccaaaagtgcaatgagcatttactaaattcattaaaagattacttctttgttttagggtcaacatcaagctcaagaaaatatatattaaaaaaaagtgaattaaattttttatctgtccaaataaaaattaatgaaaaaaaaataggatgtagaaaaaaacttgacccatttacattaacatctaatatatcagtagcaaagggaatgaaactattacatgttattaataatgataataaattaaaacaacaaattttagaattaagtaaaaacaaaaaagttttattgttagtaggagatgaagttatttattgtaataaccaaatatacgaaaaaccaaaaaacaaaaaagaagcatataattttattaaatcttataataataataaatgttatagttatagctctattacattaatcgatttagtgtctaacaaaattatgactggaattgatgagtcagttttaagctttactaatatgagtgacgacactatagaaaatattttaaacgaccaatctatctattattgcgctggtgcattaaagattgaaaatgttattatgagtaaatatttgcaagaaatcaagggaaatatcgacagcatttttggcttgtccctgaatctcctatttcatttaatcaacttgttatgactttaccccctaccgctcattagccaacctaccacttagccagcacattatctcatttattgctatttttatttttctccaactttttgtttgacatctattcactacacacatatgtgcatgcacccactcagccgttccgacaaactaaatttgaatacacatattctataacagtgcataattctttatactttattatccatactttcattattatacatatataatataaccactttaaaggtgcttacatattacatttgagttcagtaaaaaaaaaaaaaaaaaaaaataaaataaaataaaataaataaatatatttataccatatatgtgtatgaatagggtgaaaaaatgatcataaagaaaagagtgatttaattatgtgtatgtatgagcacttggtttgaattgtaaaacaaatccaatctacaactattttattcgtttctatctttgtatgatatcttattttcttttattataataaactaatataaggactaatttattcattttactattttatttttttctaaaattaatggatcaatagctggtacactaggagatttcgatcttcctttttcaagaaggttttgaaaaaaactatgcaaaaatttatcgcttttatcattattattttcattatttgttgaattataattattattttcattattatcaagattattatttcgatttcctttgtctgtatttctcactccatttgataatgcactattatcaatatcaatagaattcatgtctttttttatatattcattttctatgttatcattagaagggtttgtagatatactagataaaaaatcgttataataaattgcaggaactatattttgactatgttcagcaacaattgttttatttgtcattggtttaataataatagaatcatatggtttgttaaaatttccaacaaaagtatttttaattgatttatttattaatttttcatcatcatatcctgatggtataaatattttttcataacaatctaatatttcattttctttaaatgggaaatcatataatctatgcattatatatttatataaaagttctatattaattaattcatttttatttattgtattacaaaatatgattgcaccttgataacttatagctaaatttcttaaataagatatgattacatctatatatccttgataggttctattatttaatatttcatatccatccgatttacatatcacaaaaattattggaaaagataaatttatttttattaattttttttgattttcttcattttttacattgtctatattttgttctaaacccgaatatacatcaatttctcgattctcttttttttcacaattttttccttgtttgtaattatatatatatttttctaattcatcttttaacccactaacaatatctatatcataatttgaatacaattcctcataaattttatgcataacatcaacccaagtatttatttcagaaattatattatatggtttatataaatcagtacaaattaatataataattttttttatattttgaatttttttaagatttttaattaacaaactagtataaaaaggatgttgtaaaatccaaacatgactattaccttgtgtatcatgtatttttttatcatcttcgaaattttttatatttaaacatccataatcaaaaggcaatactcttatttcacttctatataataagtctaaatattctccatcattttctaatgctattttttgcaatgcttttaataatgaagattttcccacatctttatttcctaaaattattatatgactactttcaacttgttcatttttatctatatttaatttttttaatatttttttatatacactactctgttcatcttttattccttcttcgccattttttttttctgaattttctgcattttcaaacttgatttcatttttcaaaaaaatatttaccttgccattgttaaaccctgaactttccacttcaattggtactccactctctacttcattcctcacctcatttctcacctcatttctcacttcatttcccacttcattttccacttcatttctcacttcattttccacttcattttccacttcatttctcacttcattttccacttcatttcccacttcatttctcacttcattttccacttggctctcttgcatggtcagctttttactaataacctggctaccatttttattgtctttttgtttttttttatttttaaaattatcatcattctttaattttgaagtagctaatatatttgcactacttcccttgaccatatttatattattttttttattaaacaaattttcttttttatttcctgaatcttttgggatttctcttccatttcctgaatcttttgggatttctcttccatttcctgaatcttttggaatttctcttccatttccagaatcttttggaatctcctttacatttcccttttttttccacaatgtaacagtacttcctcttttcaaaaagctagctgagtggtttgaattgttagaagtgttagacatttctttcttcatttttaacaccgtttatatatcctaacctatgcactatattgcgtttgcgcatgtactatcttttacatgtactatcttttacatgtattacgttttacatgtattacgttttacatatatttgtaacttgccccttttttacttattttcaaatatgcaagaccgaccaaatgaaaaataaaataaaaaaagaaaaaaaaaagaaaaaaaaagaaaaaaaaaaaggaaaaaaaaaaaaagccgtatccgttttataaataaaatactaaatatatttcactgcattttgttaattgttgtcttaacaaaatgcttgaattaaatataaaaaatagatagaagaaaaaaaaaaaaaaattcggtcaaataatttgaatgatgtagtaaactgttataaaggtgactgtttaaaccaaaagcaaaacttggaaaaatcaaacatggaaaaaataaaacatggaaaaataaaacgtggaaaaataagaataacatttatgttaaatttatcaactatatatatatttttttttttttttaaattcaaatgtgcatagtattttaaatttttttttttttttttttttttttttttatttccttaaatttgttcaatataaatacaaacagttttgtctacaaattgttttataatatgttcttaaataagttacaaaataaaaaattgtctttttttttagagaaatatattatgctgttttgccattatcaccttgtaaacgaatatttatttgatcatttgtttgatcattttcctacccattttcctatcaatttgtttgcgttataaaggcaagcaaaaaagttaatgcatataaaactgccgataaaattacattccccatattttcattttccaacaaatacaaaacagtaactattgtatcatagccttaaacctcccatttgccaactttaaaaattggggaaaaagctgaaaaaaaagctgaaaaaaaagctgaaaaaattgggaaaaaaagctgaacaaaattggggaaaaaagctgaaaaaacattcgtgtgctacatatttccttcactattcatttcctaaacccaataaaatatgtggtttataggtagttcatataattgatacattgccaacagttcgatacattttttttaaatatatttttatgaatgtgataaaaatggtaaaaacattataatcgttttatatatacataacagggtttatactcaccacctacaaaatacagtggcacatattttgtgaaaaaaaaaaaaaaaaaaaaataaataaacccaaaacaaaaaaaagaaaaaaaaaaacatatttgacccaattagtgttatttccccaaatatatggttaattaagttgcaaattttttaattttgtataatttcttataaatttaatttatttataattcattaatttgtatatagttatatattatttatttgtttcattttgaaatataattaaaagtttctatctattttatgtttacctctatttgatactttacactcttttatataattcaaatcaaatgcaatctatttttttataacctcatttaagcaacgatttccaaagtttgatttactcaccccccccctaacattaaataattgagaaactgaccaaatatataataagatcgaccaaattgtaaaaaaaaaaaaaaaacaaaaaaaaaacaaaaaaaaaaacaaaatgtacgaatgtatccaaaactacttaacaaaacatatagatgaacaaaatatttatgttaaaaaatgtgtttcaattattgggtctccattagctgctggccaatctcttggaggtgtaaataaagcatgtgacaatttgaggcaactcggattatatgatgttattaaagctatgggttggaaatataacgatattggaaatattggggaaagtatatcgatcaatacttttctaaattcagcaaatgccgaaaagggaatcaaaaaggaggctgaaaaggaggctgaaaagggagccaaaaaggaggctgaaaaggaggctgaaaagggagccaaaataaatggcaatgaatcaaactactatagcaatataaaaaacgcacaagtgattggcaaatttagtgaacaattatttcaaatcatgagttcagaaataaaaaaaaaaaattttattttaaatattgggggagatcatggagtagctttttcaagcatactagccacactacaaacatataaaaatttaaaagtgatatggatagatgcacatggagatataaatataccagaaacatctccttctggaaattatcatggaatgtcattagcacatgtattaggattgtttaaaaaaaaagttccacattttgaatggtcagaaaatttgttacatttaaaaccagaaaatgtagctattattggaataagagatattgataaatatgaaaaaatcattttaaaaaattgtaatataaattattatactatgtttgatatagataaaaaaggtatatacaacattatttgtgaagctttaaataaaattgatccagatcaaaattctcctatacatatatcattagatattgatagtgtcgattcaatatatgctcctggaactggaacaatagctaaaggtggtttaaattatagagaaataaatttattaatgaaatcgatatcagatacaaaacgagttgtatctatggatattgttgaatataacccacttttggatgaaaatgataaagcagttcatggagattcgctaccaattgatcccaatgctactaaaactggaaaattatgtcttgagcttattgccagagtcctaggcaatgatatcgtgtaaccgtgccagagttatagcaatgatatcgtgtaaccgtgccagagttataggcaatgatatcgtgtaaacgtatccyttcccccattttnnttnnncnncnccccccaaaattngggcacatgcacgnntatgcatcgtttggcttagtacatgcgccactgaaccaacagcattactaaattattattttttaaaaacatctctggaaag

SEQ ID NO: 54 - protein, 338 aa, Lycopersicon esculentum
MKSAGSMGINYMQKLLTSNVPKEVVKRGQDRVVEASLTLIRERAKLKGELVRGLGGAVASTSLLGIPLGHNSSFLQGPAFAPPLIREAIWCGSTNSTTEEGKILDDQRVLTDVGDLPVQELRDTGIDDDRLMSTVSESVKLVMDENPLRPLVLGGDHSISYPVVRAVSEKLGGPVDILHLDAHPDIYDAFEGNKYSHASSFARIMEGGYARRLLQVGIRSINLEGREQGKRFGVEQYEMRTFSRDRQFLENLKLGEGVKGVYISVDVDCLDPAFAPGVSHFESGGLSFRDVLNILHNLQGDIVGADVVEYNPQRDTADGMTAMVAAKLVRELAAKMSK

SEQ ID NO: 55 - protein, 338 aa, Lycopersicon esculentum
MRSAGRMGIHYMQKLHASNVPKELVEKGQNRVIEASLTLIRERAKLKGELVRALGGAVASTSLLGVPLGHNSSFLQGPAFAPPRIREAMWCGSTNSTTEEGKELDDPRILTDVGDVPVQELRDAGVDDDRLMSIISESVKLVMEENPLRPLVLGGDHSISYPVVRAVSEKLGGPIDILHLDAHPDIYHAFEGNKYSHASSFARIMEGGYARRLLQVGIRSINKEGREQGKRFGVEQYEMRTFSQDRQFLENLKLGEGVKGVYISVDVDCMDPAFAPGVSHIEPGGLSFRDVLNILHNLQADVVGADVVEFNPQRDTVDGMTAMVAAKLVRELTAKISK

SEQ ID NO: 56 - protein, 338 aa, Lycopersicon esculentum; identical to SEQ ID NO: 55

SEQ ID NO: 57 - protein, 338 aa, Lycopersicon esculentum; identical to SEQ ID NO: 54

SEQ ID NO: 58 - protein, 338 aa, Solanum tuberosum
MKNAGRMGIHYMQKLHASNVPKELVEKGQNRVIEASLTLIRERAKLKGELVRALGGAVASTSLLGVPLGHNSSFLQGPAFAPPRIREAMWCGSTNSTTEEGKELDDPRILTDVGDVPVQELRDAGVDDDRLMSIISESVKLVMEENPLRPLVLGGDHSISYPVVRAVSEKLGGPIDILHLDAHPDIYDAFEGNKYSHASSFARIMEGGYARRLLQVGIRSINKEGREQGKRFGVEQYEMQTYSQDRQFLENLKLGEGVKGVYISVDVDCMDPAFAPGVSHIEPGGLSFRDVLNILHNLQADVVGADVVEFNPQRDTVDGMTAMVAAKLVRELTAKISK

SEQ ID NO: 59 - protein, 343 aa, Lotus corniculatus
MFPKGMSTIARRGIHYMQEIQAAKVSPASLEQGQKGVIEASLALIRENAKLKGELVRAYGGAVATSSLLGVPLGHNSSFLQGPAFAPPHIREAIWCGSTNSTTEEGKDLRDPRVLASVGDLAVQEIRECGVDDHRLMNVVSDAVKLVMEEDPLRPLVLGGDHSITYPIVRAISEKLGGPIDLLHFDAHPDLYHEFEGNFYSHASSFARIMEGGYARRLLQVGIRSINYEGREQAKKFGVEQYEMRTYSKDRPFLENLKLGEGVKGVYISIDVDCLDPGYAPGVSHHESGGLSFRDVMNVLQNLQGDIVGGDVVEYNPQRDTADDMTAMVAAKFVRELAAKMSK

SEQ ID NO: 60 - protein, 342 aa, Arabidopsis thaliana
MSRIIGRKGINYIHRLNSASFTSVSASSIEKGQNRVIDASLTLIRERAKLKGELVRLLGGAKASTSLLGVPLGHNSSFLQGPAFAPPRIREAIWCGSTNSATEEGKELKDPRVLTDVGDVPVQEIRDCGVDDDRLMNVISESVKLVMEEEPLRPLVLGGDHSISYPVVRAVSEKLGGPVDILHLDAHPDIYDCFEGNKYSHASSFARIMEGGYARRLLQVGIRSINQEGREQGKRFGVEQYEMRTFSKDRPMLENLKLGEGVKGVYISIDVDCLDPAFAPGVSHIEPGGLSFRDVLNILHNLQADVVGADVVEFNPQRDTVDGMTAMVAAKLVRELAAKISK

SEQ ID NO: 61 - protein, 342 aa, Arabidopsis thaliana; identical to SEQ ID NO: 60

SEQ ID NO: 62 - protein, 344 aa, Arabidopsis thaliana
MWKIGQRGVPYFQRLIAAPFTTLRSLPTSLVETGQNRVIDASLTLIRERAKLKGELVRLIGGAKATTALLGVPLGHNSSFLEGPALAPTHVREAIWCGSTNSTTEEGKELKDPRVLSDVGDIPVQEIREMGVDDDRLMNVVSESVKLVMEEEPLRPLVIGGDHSISYPVVRAVSEKLGGPVDILHLDAHPDIYDRFEGNYYSHASSFARIMEGGYARRLLQVGIRSINKEGREQGKRFGVEQYEMRTFSKDRQMLENLKLGEGVKGVYISIDVDCLDPGFAHGVSHFEPGGLSFRDVLNILHNLQGDLVGADVVGYNPQRDTADDMTAMVAAKFVRELAAKMSK

SEQ ID NO: 63 - protein, 350 aa, Glycine max
MSFLRSFARNKDISKVGRRGIHCMQKLCAEKISPDSLEKAQNRVIDAALTLVRENTGLRKNLCHSLGGAVATSTLLGVPLGHNSSFLEGPAFAPPFIREGIWCGSANSTTEEGKDLKDLRIMVDVGDIPIQEMRDCGIGDERLMKVVSDSVKLVMEEDPLRPLILGGDPSISYPVVRAISEKLGGPVDVLHFDAHPDLYDEFEGNYYSHASSFARIMEGGYARRLLQVGIRSINKEGREQAKKFGVEQFEMRHFSKDRPFLENLNLGEGAKGVYISIDVDCLDPGYAVGVSHYESGGLSFRDVMNMLQNLKGDIVGGDVVEYNPQREPPDRMTAMVAAKFVRELAAKMSK

SEQ ID NO: 64 - protein, 185 aa, Glycine max
MSIITRRGIRYMPRLDAAKVSAALLEKGQNRVIDASLTLIRERAKLKGELVRALGGAKATSTLLGVPLGHNSSFLQGPAFAPPRIREAIWCGSTNSTTEEGKELQDARVLTDVGDVPIQEIRDCGVDDHRLMNVIGESVKLVMEEDPLCPLVLGGDHSISFPVIRAVSEKLGGPVDVLHLDAHPD

SEQ ID NO: 65 - protein, 350 aa, Glycine max
MSFLRSFARNKDISKVGRRGIHCMQKLCAEKISPDSLEKAQNRVIDAALTLVRENTRLKKELVHSLGGAVATSTLLGVPLGHNSSFLEGPAFAPPFIREGIWCGSANSTTEEGKDLKDLRIMVDVGDIPIQEMRDCGIGDERLMKVVSDSVKLVMEEDPLRPLILGGDHSISYPVVRAISEKLGGPVDVLHFDAHPDLYDEFEGNYYSHASSFARIMEGGYARRLLQVGIRSINKEGREQAKKFGVEQFEMRHFSKDRPFLENLNLGEGAKGVYISIDVDCLDPGYAVGVSHYESGGLSFRDVMNMLQNLKGDIVGGDVVEYNPQRDTPDRMTAMVAAKFVRELAAKMSK

SEQ ID NO: 66 - protein, 320 aa, Glycine max
MSIITRRGIRYMPRLDAAKVSAALLEKGQNRVIDASLTLIRERAKLKGELVRALGGAKATSTLLGVPLGHNSSFLQGPAFAPPRIREAIWCGSTNSTTEEGKELQDARVLTDVGDVPIQEIRDCGVDDHRLMNVIGESVKLVMEEDPLCPLVLGGDHSISFPDIRAVSEKLGGPVDVLHLDAHPDNYDAFEGNIYSHASSFARVMEGDYVRRLLQVGIRSITAEGRAQAKKFGVEQYEMRTFSRDRPFLENLKLGEGVKGVYISIDVDCLDPAFAPGVSHIEPGGLSFRDVLNILHNLQGAVVAGDVVELNPQRDTDDGM

SEQ ID NO: 67 - protein, 334 aa, Brassica napus
MSRIIGRKGINYIHRLNSASFTSVSASSIEKGQNRVIDASLTLIRERAKLKGELVRLLGGAKASTSLLGVPLGHNSSFLQGPAFAPPRIREAIWCGSTNSATEEGKELKDPRVLTDVGDVPVQEIIDCGVDDDRLMNVISESVKLVMEEKPLRPLVLGGDHSISYPVVRAVSEKLGGPVDILHLDAHPDIYDCFEGNKYSHASSFARIMEGGYARRLLQVGIRSINQEGREQGKRFGVEQYEMRTFSKDRPMLENLKLGEGVKGVYISIDVDCLDPAFAPGVSHIEPGGLSFRDVLNILHNLQADVVGADVVEFNPQRDTVDGMTAMVAAKLVR

SEQ ID NO: 68 - protein, 220 aa, Pinus taeda
MSIIGKRGIHYLQKLKTANIPPELLEKGQNRVIDASLTLIRERAKLKGELLRALGGVKASSTLLGVPLGHNSSFLQGPAFAPPRIREAIWCGSTNSSTEEGKELNDPRVLTDVGDVPVQEIRDCGVDDDRLMNVISESVKLVMEEDPLRPLVLGGDHSISFPVVRAVSEKLGGPVDILHLDAHPDIYHCFEGNKYSHASSFARIMEGGYALGFCKWVSDQ

SEQ ID NO: 69 - protein, 174 aa, Picea glauca
LRATEQLGGPVIHLDAHPDIYHSFEGNKYSHASFARIMEGGHARRLLQVGIRSITKEGREQGKRFGVEQYEMHSFSKDREFLENLKLGEGVKGVYISIDVDCLDPAFAPGVSHLEPGGLSFRDVMNIVQNLQGDIVAADVVEFNPQRDTVDGMTAMVAAKLVRELTSKMSKLAD

SEQ ID NO: 70 - protein, 341 aa, Cabernet sauvignon
MRNIARKGIHYWQKLNAANVPAELIENGQNRVIDASLTLIRERAKLKGELVRALGGALASSSLLGVPLGHNSSFLQGPAFAPPRIREAIWCGSTNATTEEGKELNDPRVLTDVGDVPVQEIRDCGVDDDRLMKIISESVKLVMEEDPLRPLVLGGDHSISFPVVRAVSEKIGGPVDILHLDAHPDIYHSFEGNKYSHASPFARIMEGGYARRLLQVGLRSITSEGREQGKRFGVEQYEMRTFSRDRHILENLKLGEGVKGVYISLDVDCLDPAFAPGVSHIEPGGLSFRDVLNILHNLQADVVAADVVEFNPQRDTVDGMTAMVAAKLVRELTAKMSKMKN

SEQ ID NO: 71 - protein, 246 aa, Saccharum officinarum
MGGAAAGTKWIHHIQRLSAVKVSAEAVERGQSRVIDASLTLIRERAKLKAELLRALGGVKASASLLGVPLGHNSSFLQGPAFAPPRIREAIWCGSTNSSTEEGKELNDPRVLTDVGDVPIQEIRDCGVEDDRLMHVISESVKTVMEEEPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSK

SEQ ID NO: 72 - protein, 340 aa, Gossypium raimondii
MSSSGVVRRGIHYLQKLKAANIPSDLIEKGQNRVIDASLTLIRERAKLKGELVRALGGALASTSLLGVPLGHNSSFLQGPAFAPPRIREAIWCGSTNSATEEGKELNDPRVLTDVGDVPVQEIRDCGVDDDRLMSVISESVKLVMEEDPLRPLVLGGDHSISFPVVRAVSEKLGGPVDILHLDAHPDIYDCFEGNKYSHASSFARIMEGGYARRLLQVGIRSITTEGREQGKRFGVEQYEMRTFSKDCHFLENLKLGEGVKGVYISVDVDCLDPAFAPGVSHIEPGGLSFRDVLNILPNLEGNLVAADVVEFNPQRDPVDGMTAMVAAKLVRELAAKMSK

SEQ ID NO: 73 - protein, 340 aa, Sorghum bicolor
MGGAAAGTKWIHHIQRLSAAKVSTEAVERGQSRVIDASLTLIRERAKLKAELLRALGGVKASASLLGVPLGHNSSFLQGPAFAPPRIREAIWCGSTNSSTEEGKELNDPRVLTDVGDVPIQEIRDCGVEDDRLMHVISESVKTVMEEEPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSKDREKLENLKLGEGVKGVYVSVDVDCLDPAFAPGVSHIEPGGLSFRDVLNILQNLQGDVVAADVVEFNPQRDTVDGMTAMVAAKLVRELTAKISK

SEQ ID NO: 74 - protein, 340 aa, Zea mays
MGGAAAGTKWIHHIQRLSAAKVSAEAVERGQSRVIDASLTLIRERAKLKAELLRALGGVKASASLLGVPLGHNSSFLQGPAFAPPRIREAIWCGSTNSSTEEGKELNDPRVLTDVGDVPIHEIRDCGVEDDRLMHVISESVKTVMEEEPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSKDREKLENLKLGEGVKGVYVSVDVDCLDPAFAPGVSHIEPGGLSFRNVLNILQNLQGDVVAADVVEFNPQRDTVDGMTAMVAAKLVRELTAKISK

SEQ ID NO: 75 - protein, 341 aa, Hordeum vulgare
MGGAAAAASGAARWIQRLSAARISTEALERGQSRVIDASLTLIRERAKLKGELLRAMGGVKASATLLGVPLGHNSSFLQGPAFAPPRIREAIWCGSTNSSTEEGKELNDPRVLTDVGDVPIQEIRDCGVEDDRLMHVISDSVKTVMDEDPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSRDREKLENLKLGEGVKGVYVSVDVDCLDPAFAPGVSHIEPGGLSFRDVLNILQNLQGDVVAGDVVEFNPQRDTVDGMTAMVAAKLVRELSAKISK

SEQ ID NO: 76 - protein, 340 aa, Triticum aestivum
MGGAAAAAGAARWIQRLSAARISTEALERGQSRVIDASLTLIRERAKLKGELLRAMGGVKASATLLGVPLGHNSSFLQGPAFAPPRIREAIWCGSTNSSTEEGKELNDPRVLTDVGDVPIQEIRDCGVEDDRLMHVISESVKTVMDEDPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSRDREKLENLKLGEGVKGVYVSVDVDCLDPAFAPGVSHIEPGGLSFRDVLNILQNLQGDVVAGDVVEFNPQRDTVDGMTAMVAAKLVRELSAKISK

SEQ ID NO: 77 - protein, 340 aa, Oryza sativa
MGGVAAGTRWIHHVRRLSAAKVSADALERGQSRVIDASLTLIRERAKLKAELLRALGGVKASACLLGVPLGHNSSFLQGPAFAPPRIREAIWCGSTNSSTEEGKELNDPRVLTDVGDVPIQEIRDCGVEDDRLMNVVSESVKTVMEEDPLRPLVLGGDHSISYPVVRAVSEKLGGPVDILHLDAHPDIYDAFEGNIYSHASSFARIMEGGYARRLLQVGIRSITKEGREQGKRFGVEQYEMRTFSKDREKLESLKLGEGVKGVYISVDVDCLDPAFAPGVSHIEPGGLSFRDVLNILHNLQGDVVAGDVVEFNPQRDTVDGMTAMVAAKLVRELTAKISK

SEQ ID NO: 78 - protein, 680 aa, Oryza sativa
MGGVAAGTRWIHHVRRLSAAKVSADALERGQSRVIDASLTLIRERAKLKAELLRALGGVKASACLLGVPLGHNSSFLQGPAFAPPRIREAIWCGSTNSSTEEGKELNDPRVLTDVGDVPIQEIRDCGVEDDRLMNVVSESVKTVMEEDPLRPLVLGGDHSISYPVVRAVSEKLGGPVDILHLDAHPDIYDAFEGNIYSHASSFARIMEGGYARRLLQVGIRSITKEGREQGKRFGVEQYEMRTFSKDREKLESLKLGEGVKGVYISVDVDCLDPAFAPGVSHIEPGGLSFRDVLNILHNLQGDVVAGDVVEFNPQRDTVDGMTAMVAAKLVRELTAKISKMGGVAAGTRWIHHVRRLSAAKVSADALERGQSRVIDASLTLIRERAKLKAELLRALGGVKASACLLGVPLGHNSSFLQGPAFAPPRIREAIWCGSTNSSTEEGKELNDPRVLTDVGDVPIQEIRDCGVEDDRLMNVVSESVKTVMEEDPLRPLVLGGDHSISYPVVRAVSEKLGGPVDILHLDAHPDIYDAFEGNIYSHASSFARIMEGGYARRLLQVGIRSITKEGREQGKRFGVEQYEMRTFSKDREKLESLKLGEGVKGVYISVDVDCLDPAFAPGVSHIEPGGLSFRDVLNILHNLQGDVVAGDVVEFNPQRDTVDGMTAMVAAKLVRELTAKISK

SEQ ID NO: 79 - protein, 220 aa, Populus euphratica; identical to SEQ ID NO: 68

SEQ ID NO: 80 - protein, 230 aa, Allium cepa
MSTHAIKWIQSLKRMSTGNLPAEIIEKGQNRVIEASLTLIRERAKLKGELLRALGGAKASATLLGVPLGHNSSFLQGPAFAPPRIREAIWCGSTNSATEEGKDLKDSRILTDVGDVPIQEIRDCGVDDDRLMNIISESVKLVMEEHPLRPLVLGGDHSISYPVVRAVAEKLGGPVDILHLDAHPDIYDAFEGNKYSHASSFAKIMEGGHARRPFTSWNKGQLLMKDGNKG

SEQ ID NO: 81 - protein, 140 aa, Capsicum annuum
GGYARRLCQVGIRSINKEGREQGKRFGVEQYEMRTFSRDREYLENLKLGEGVKGVYISVDLDCMDPAFAPGVSHIEPGGLSFRDVLNILHNLQADVVGADVVEFNPQRDTVDGMTAMVAAKLVRELTAKISKWPAVIPNL

SEQ ID NO: 82 - protein, 163 aa, Theobroma cacao
MSAIGPEQRNSLFAETECCKYPSDLIEKGQSRVIDASLTLIREKAKLKGELVRALGGSLASTSLLGVPLGHNSSFLQGPAFALPRIREAMWCGSTNSSTEEGKELKDPRVLTDVGDLAVQEIRDCGVDDDRLMNVVSESVKIVMEEDPLRPLVLGGATQYLIL

SEQ ID NO: 83 - protein, 338 aa, Medicago truncatula
MSTIARRGIHYMQRLNSANVSSALLENGQNRVIDASLTLIRERAKLKGELVRALGGAVATSSLLGVPLGHNSSFLQGPAFAPPRIREAIWCGSTNSTTEEGKDLQDARVLTDVGDVPIQEIRDCGVDDHRLMNVIGESVKLVMEEDPLRPLVLGGDHSISFPVIRAVSEKLGGPVDVLHLDAHPDNYDEFEGNYYSHASSFARVMEGNYVRRLLQVGIRSITTEGRAQAKKFGVEQYEMRTFSRDRHFLENLKLGEGVKGVYISIDVDCLDPAFAPGVSHIEPGGLSFRDVLNILHNLQGDVVAGDVVEFNPQRDTVDGMTAMVAAKLVRELAAKIAK

SEQ ID NO: 84 - protein, 342 aa, Arabidopsis thaliana; identical to SEQ ID NO: 60

SEQ ID NO: 85 - protein, 344 aa, Arabidopsis thaliana; identical to SEQ ID NO: 62

SEQ ID NO: 86 - protein, 351 aa, Drosophila melanogaster
MWWSRKFASRSLRLHRLKSTGSTAPREPEQSLGIIGVPFAKGQAKQGVELAPDLLRQSSLRQVLQSSHDGLVIRDYGNLQYAVDEPLLQQQRVHYHHIRNYADFMACNRALIEQVKLMLVENTQFLAIGGDHAIGFGSVAGHLQHTPNLSLVWIDAHADINLHSTSQSGNIHGMPVSFLLEQLRNTWQHAGLQEIAPNCLPKDQLVYIGLRDIDPYEAFILNKVGIRYYAMDTIDRVGVPKIIEMTLDALNPQNKIHVSFDIDALDSNVAPSTGTAVRGGLTLREGISIVEALRDTKRVQGVDLVEINPKLGSERDVRTTVESGLEILKSMFGYRRSGRWSNIDTGILGSD

SEQ ID NO: 87 - protein, 347 aa, Danio rerio
MAMRGPLSRLLKSTLTSCQQNRSHSVAILGAPFSKGQKRRGVEHGPKAIRDAGLVERLSNLDYPVHDFGDLTFKHLEKDEHFMHVPFPRTVGRANQLLSGAVSGAVGAGHTCIMLGGDHSLAIGSVEGHSQQCPDLCLIWVDAHADINTPLTSPSGNLHGQSVAFLLKDLQNKMPKVPGFSWMKPFLSARDLVYIGLRDVDPGEHVFLKTLGIQYFSMRDIDRMGIQRVMEVTLDHLLARKQRPIHLSFDIDAFDPSLAPATGTPVNGGLTYREGIYITEEIHNTGLLSVMDVVEVNPTLGAAPEAVEATTSLAVDIVASALGQTREGAHVSFPKITEPKEDTELRL

SEQ ID NO: 88 - protein, 323 aa, Xenopus laevis
MSSQGKTSVGVIGAPFSKGQPRRGVEEGPKYLREAGLIEKLREFGNDVRDCGDLDFPDVPNDTPFNNVKNPRTVGKATEILANAVTAVKKADKTCLTIGGDHSLAVGTIAGHAAVHPNLCVVWVDAHADINTPSTSPSGNLHGQPLSFLMKELKSKMPAVPGFEWVKPCLRSKDIVYIGLRDVDPGEHYILKTLGIKYYSMSEVDYLKIDKVMEETLEYLVGKHKRPIHLSFDIDGLDPSIAPATGTPVPGGLTYREGMYITEQLHKTGLLSAVDIMEVNPSRGETKRDVEVTVKTALDMTLSCFGKAREGFHASTMMLPDIF

SEQ ID NO: 89 - protein, 340 aa, Gallus gallus
MICLLRTARLSARLLFASAAAPCRRASRFNVPPSAEFVARPVGVCSMLRLPVQTSAEGLDAAFVGVPLDTGTSNRPGARFGPQQIRAESVMVRRYNASTGAAPFDSLLVADVGDVNVNLYNLPDSCRRIRESYQKIVASGCVPLTLGGDHSITYPILQAVAEKHGPVGLVHVDAHTDTSDMALGEKIYHGTPFRRCVDEGLLDCSRVVQIGIRGSSYAPNPYKYCWDQGFRVVPAEECWMKSLVPLMGEVRQQMGDGPVYISFDIDGLDPAYAPGTGTPEIAGLTPMQALEIIRGCKGLNIVGCDLVEVAPIYDVSGNTALLGANLLFEMLCVLPGVKTM

SEQ ID NO: 90 - protein, 323 aa, Rattus norvegicus
MSSKPKPIEIIGAPFSKGQPRGGVEKGPAALRKAGLVEKLKETEYNVRDHGDLAFVDVPNDSPFQIVKNPRSVGKANEQLAAVVAETQKNGTISVVLGGDHSMAIGSISGHARVHPDLCVIWVDAHTDINTPLTTSSGNLHGQPVAFLLKELKGKFPDVPGFSWVTPCISAKDIVYIGLRDVDPGEHYIIKTLGIKYFSMTEVDKLGIGKVMEETFSYLLGRKKRPIHLSFDVDGLDPVFTPATGTPVVGGLSYREGLYITEEIYKTGLLSGLDIMEVNPTLGKTPEEVTRTVNTAVPLTLSCFGTKREGNHKPETDYLKPPK

SEQ ID NO: 91 - protein, 353 aa, Rattus norvegicus
MFLRSSVSRLLHGQIPCALTRSVHSVAVVGAPFSRGQKKKGVEYGPAAIREAGLLKRLSMGCHIKDFGDLSFTNVPKDDPYNNLVVYPRSVGIANQELAEVVSRAVSGGYSCVTLGGDHSLAIGTISGHARHHPDLCVIWVDAHADINTPLTTVSGNIHGQPLSFLIRELQDKVPQLPGFSWIKPCLSPPNLVYIGLRDVEPAEHFILKSFDIQYFSMRDIDRLGIQKVMEQTFDRLIGKRKRPIHLSFDIDAFDPKLAPATGTPVVGGLTYREGLYITEEIHSTGLLSALDLVEVNPHLATSEEEAKATASLAVDVIASSFGQTREGGHIAYDHLPTPSSPHESEKEECVRI

SEQ ID NO: 92 - protein, 323 aa, Mus musculus
MSSKPKSLEIIGAPFSKGQPRGGVEKGPAALRKAGLLEKLKETEYDVRDHGDLAFVDVPNDSSFQIVKNPRSVGKANEELAGVVAEVQKNGRVSVVLGGDHSLAVGSISGHARVHPDLCVIWVDAHTDINTPLTTSSGNLHGQPVSFLLKELKGKFPDVPGFSWVTPCISAKDIVYIGLRDVDPGEHYIIKTLGIKYFSMTEVDKLGIGKVMEETFSYLLGRKKRPIHLSFDVDGLDPAFTPATGTPVLGGLSYREGLYITEEIYKTGLLSGLDIMEVNPTLGKTAEEVKSTVNTAVALTLACFGTQREGNHKPGTDYLKPPK

SEQ ID NO: 93 - protein, 353 aa, Mus musculus
MFLRSSASRLLHGQIPCVLTRSVHSVAIVGAPFSRGQKKLGVEYGPAAIREAGLLKRLSRGCHLKDFGDLSFTNVPQDNPYNNLVVYPRSVGLANQELAEVVSRAVSGGYSCVTMGGDHSLAIGTIIGHARHRPDLCVIWVDAHADINTPLTTVSGNIHGQPLSFLIKELQDKVPQLPGFSWIKPCLSPPNIVYIGLRDVEPPEHFILKNYDIQYFSMREIDRLGIQKVMEQTFDRLIGKRQRPIHLSFDIDAFDPKLAPATGTPVVGGLTYREGVYITEEIHNTGLLSALDLVEVNPHLATSEEEAKATARLAVDVIASSFGQTREGGHIVYDHLPTPSSPHESENEECVRI

SEQ ID NO: 94 - protein, 322 aa, Sus scrofa
MSFKSQSIGIIGAPFSKGQPRGGVEEGPTALRKAGLLEKLKEQECDVKDYGDLCFADVPNDTPFQIVKNPRSVGKANQQLADVVAEIKKNGRTSLVLGGDHSMAIGSISGHARVHPDLCVIWVDAHTDINTPLTTTTGNLHGQPVSFLLKELKEKIPEVPGLSWVTPCLSAKDIVYIGLRDVDPAEHYILKTLGIKYFSMIEVDKLGIGKVMEEAFSYLLGRKKRPIHLSFDVDGLDPFFTPATGTPVHGGLSYREGIYITEEIYKTGLLSGLDIMEVNPSLGKTPEEVTRTVNTAVALVLACFGVAREGNHKPIDYLKPPK

SEQ ID NO: 95 - protein, 322 aa, Homo sapiens [sequence omitted]

SEQ ID NO: 96 - protein, 353 aa, Homo sapiens
MSLRGSLSRLLQTRVHSILKKSVHSVAVIGAPFSQGQKRKGVEHGPAAIREAGLMKRLSSGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVPQLPGFSWIKPCISSASIVYIGLRDVDPPEHFILKNYDIQYFSMRDIDRLGIQKVMERTFDLLIGKRQRPIHLSFDIDAFDPTLAPATGTPVVGGLTYREGMYIAEEIHNTGLLSALDLVEVNPQLATSEEEAKTTANLAVDVIASSFGQTREGGHIVYDQLPTPSSPDESENQARVRI

SEQ ID NO: 97 - protein, 325 aa, Bradyrhizobium japonicum
MTDRTMPDRARRIALLGAPIDMGASQRGTLMGPPALRTAGLATLLESLDFEVVDYGDLSVAEVRDLADRPPEKANHYREIQRWTRVLSRRGYEIAKTGALPIFLGGDHTLSMGSVNAMARHWQERGRELFVLWLDAHADYNTPETTITANMHGMSAAFLCGEPGLDGLLGDDPRASIDPDRLDLFGARSIDKLEKELMRARRIRVVDMRQIDEFGVAVLIRRVIERVKASNGVLHVSFDVDFLDPCVAPGVGTTVPGGATYREAHLIMELLHDSGVVGSVDIVELNPFLDERGRTARTAVELIGSLFGQQITDRPTPSNAIAPGE

SEQ ID NO: 98 - protein, 327 aa, Agrobacterium faciens
MFILPCLHGLVQRSVGKARTGMDIRLVGAPLQIGAGQLGCEMGPSAYRVAGLAHALEELGHRVVDTGNVMPAPLREFCHPNPAVHHLAETVAWTEALTEAAYRESADAVPIFLGGDHAISAGTVAGMARRVAETGRPFFVLWLDAHTDYHTLETTRSGNLHGTPVAYFSGRDGFSGYFPPLSHAVAEENIGMIGIRSVDPAERAALEKSGITVHDMRSIDEHGVAVILREFLARVQAANGLLHVSLDVDFLEPSIAPAVGTTVPGGATFREAHLVMEMLHDSGLVCSLDLVELNPFLDERGRTATLMVDLATSLMGKRVMDRPTRAG

SEQ ID NO: 99 - protein, 323 aa, Agrobacterium faciens
NGAGEINASRHRKENELKTCQILGAPVQSGASQPGCLMGPDAFRTAGLTQVLTELGWAVTDLGDATPTVEPELSHPNSAVKNLDALVGWTRSLSQKALEMARSCDLPVFLGGDHSMSAGTVSGVAQRTAELGKEQFVLWLDAHTDLHTLHTTASGNLHGTPVAYYTGQSGFEGLPPLAAPVNPRNVSMMGIRSVDPEERRRVAEIGVQVADMRVLDEQGVVRPLEAFLDRVSKVSGRLHVSLDVDFLDPAIAPAVGTTVPGGATFREAHLIMEMLHDSGLVTSLDLAELNPFLDERGRTARLITDLASSLFGRRVFDRVTTAF

SEQ ID NO: 100 - protein, 306 aa, Brucella melitensis
MHCKILGLPVQEGTGRKGCNMGPDSYRAAGIADAIRELGHECTDLGNLAPAAQRPLQHPNHAIKALPYAVAWIEAISEAAYRESAEGFPIFLGGDHLLAAGTVPGIARRAAEKGRKQFVLWLDAHTDFHTLETTTSGNLHGTPVAYYTGQKGFEGYFPKLAAPIDPHNVCMLGIRSVDPAEREAVKKTEVIVYDMRLIDEHGVAALLRRFLERVKAEDGLLHVSLDVDFLDPSIAPAVGTTVPGGATFREAHLIMEMLHDSGLVTSLDLVELNPFLDERGRTAAVMVDLMASLLGRSVMDRPTISY

SEQ ID NO: 101 - protein, 377 aa, Plasmodium yoelii
MYECIQNYLTKHIDEQNIYVKKCVSIIGSPLAAGQSLGGVNKACDNLRQLGLYDVIKAMGWKYNDIGNIGESISINTFLNSANAEKGIKKEAEKEAEKGAKKEAEKEAEKGAKINGNESNYYSNIKNAQVIGKFSEQLFQIMSSEIKKKNFILNIGGDHGVAFSSILATLQTYKNLKVIWIDAHGDINIPETSPSGNYHGMSLAHVLGLFKKKVPHFEWSENLLHLKPENVAIIGIRDIDKYEKIILKNCNINYYTMFDIDKKGIYNIICEALNKIDPDQNSPIHISLDIDSVDSIYAPGTGTIAKGGLNYREINLLMKSISDTKRVVSMDIVEYNPLLDENDKAVHGDSLPIDPNATKTGKLCLELIARVLGNDIV

SEQ ID NO: 102 - protein, 364 aa, Schistosoma japonicum
MLKSVATPYYPVQNGETPKLLYPHVNFLGIPVNKGQPKLGTYQGPDFIRKSNFFQLVAEDGIQITDCGDVIPVELSESEDPERCGMKWSRSFTQTTLKIADRVEQLVKGSNKHSIESSNSKPSPLVIVGGDHSMATGTILGHARAKPDVCIIWVDAHGDINTPPNSTTGNIHGMPLSFLVKELQDQIPWLDDFHSIKPCLDASNLVYIGLRDLDVYETRDIRKHAIAYFTMLDVDRMGMEAVIKEALQAVNPRLEKPIHLSFDIDALDPSIAPSTGTAVPGGLTLREGLRICEEISATGKLSIVELAELNPLLGSKEDVEKTQSSAVHILRASLGHCRSGQLPMKVNNSTTNTIVRQAERIQIK

SEQ ID NO: 103 - protein, 329 aa, Leishmania mexicana
MEHVQQYKFYKEKKMSIVLAPFSGGQPHSGVELGPDYLLKQGLQQDMEKLGWDTRLERVFDGKVVEARKASDNGDRIGRVKRPRLTAECTEKIYKCVRRVAEQGRFPLTIGGDHSIALGTVAGVLSVHPDAGVIWVDAHADINTMSGTVSGNLHGCPLSILLGLDRENIPECFSWVPQVLKPNKIAYIGLRAVDDEEKKILHDLNIAAFSMHHVDRYGIDKVVSMAIEAVSPKGTEPVMVSYDVDTIDPLYVPATGTPVRGGLSFREALFLCERIAECGRLVALDVVECNPLLAATESHVNDTISVGCAIARCMMGETLLYTPHTSSKL

SEQ ID NO: 104 - protein, 333 aa, Saccharomyces cerevisiae
METGPHYNYYKNRELSIVLAPFSGGQGKLGVEKGPKYMLKHGLQTSIEDLGWSTELEPSMDEAQFVGKLKMEKDSTTGGSSVMIDGVKAKRADLVGEATKLVYNSVSKVVQANRFPLTLGGDHSIAIGTVSAVLDKYPDAGLLWIDAHADINTIESTPSGNLHGCPVSFLMGLNKDVPHCPESLKWVPGNLSPKKIAYIGLRDVDAGEKKILKDLGIAAFSMYHVDKYGINAVIEMAMKAVHPETNGEGPIMCSYDVDGVDPLYIPATGTPVRGGLTLREGLFLVERLAESGNLIALDVVECNPDLAIHDIHVSNTISAGCAIARCALGETLL

SEQ ID NO: 105 - protein, 323 aa, Schizosaccharomyces pombe
MSPHKIPEVHRHIMSSRYMEGNAVSIINMPFSGGQPKDGAELAPEMIEAAGLPEDLERLGYSVNVVQNPKFKSRPLKEGPNQALMKNPLYVSNVTRQVRNIVQQELEKQRIAVNIGGDHSLAIGTVEGVQAVYDDACVLWIDAHADINTPDSSPSKNLHGCPLSFSLGYAEPLPEEFAWTRRVIEERRLAFIGLRDLDPMERAFLRERSITAYTMHDVDKYGIARVVEMALEHINPGRRRPIHLSFDVDACDPIVAPATGTRVPGGLTFREAMYICESVAETGSLVAVDVMEVNPLLGNKEEAKTTVDLARSIVRTCLGQTLL

SEQ ID NO: 106 - protein, 358 aa, Neurospora crassa
MSPSLVDNHAAAYIAAPSSAKAPMIQKPGNTFGMSSPIESKFLSQPRDLGIVAVGFSGGQCKPGVDAAPSALIESGLLTQLREELGYRLHGDDEVHLYTDLVPKEDPPHRNMKNPRAVSNVTKRIAEQVHSHAKEGRLVLTLGGDHSIAIGTIAGSAKAIKERLGREIAVIWVDAHADINTPETSGSGNIHGMPVSFLTGLASEDKEEFFGWLKPDHLLSVKKLVYIGLRDVDPGEKRILRENGIKAFSMHDIDKHGIGRVMEMALGHIGNDTPIHLSFDVDALDPMWAPSTGTPVRGGLTLREGDFICECVHETGSLVAVDLVEVNPTLAAPNDVGAHETVRAGCSLVRCALGESLL

SEQ ID NO: 107 - protein, 296 aa, Bacillus subtilis
MDKTISVIGMPMDLGQARRGVDMGPSAIRYAHLIERLSDMGYTVEDLGDIPINREKIKNDEELKNLNSVLAGNEKLAQKVNKVIEEKKFPLVLGGDHSIAIGTLAGTAKHYDNLGVIWYDAHGDLNTLETSPSGNIHGMPLAVSLGIGHESLVNLEGYAPKIKPENVVIIGARSLDEGERKYIKESGMKVYTMHEIDRLGMTKVIEETLDYLSACDGVHLSLDLDGLDPNDAPGVGTPVVGGISYRESHLAMEMLYDAGIITSAEFVEVNPILDHKNKTGKTAVELVESLLGKKLL

SEQ ID NO: 108 - protein, 299 aa, Bacillus caldovelox
MKPISIIGVPMDLGQTRRGVDMGPSAMRYAGVIERLERLHYDIEDLGDIPIGKAERLHEQGDSRLRNLKAVAEANEKLAAAVDQVVQRGRFPLVLGGDHSIAIGTLAGVAKHYERLGVIWYDAHGDVNTAETSPSGNIHGMPLAASLGFGHPALTQIGGYSPKIKPEHVVLIGVRSLDEGEKKFIREKGIKIYTMHEVDRLGMTRVMEETIAYLKERTDGVHLSLDLDGLDPSDAPGVGTPVIGGLTYRESHLAMEMLAEAQIITSAEFVEVNPILDERNKTASVAVALMGSLFGEKLM

SEQ ID NO: 109 - protein, 301 aa, Bacillus halodurans
MNKFQKVSIIGVPMDLGQKRRGVDMGPSAMRYAGLIEEIEALGFEVKDYGDIPINRPATSETQEGPLRNLDEVVKVSEELCKGVAAIEAEHSFPLILGGDHSISIGSIAGIRKSYNNLGVIWYDAHPDLNTEETSPSGNIHGMPLAVNLGIGHERLMNIGGITPKVKPEHIVIIGARSIDEGERQLIREQGIKVYTMHEVDRMGMTRVIEETIDYLSARTDGVHLSFDLDGIDPVDAPGVGTPVLGGISYRESHLALEMLAESELITSAEFVEINPILDNKNQTANVAVALVTSLLGKKLL

SEQ ID NO: 110 - protein, 288 aa, Bacillus brevis
PMDLGADRRGVDMGPSAIRYAGVVARLEKMGFNIEDRGDIFVTLPHHFTETENHKYLDEVVEANEKLANVVSDIMTAGRFPLVLGGDHSIALGTIAGVAKHVKNLGVICLDAHGDLNTGATSPSGNIHGMPLAASLGYGHERLTNIGGYTPKVKAENVVIIGARDLDQGERELIKRIGMKVFTMHEIDKLGMARVMDEAIAHVSKNTDGVHLSLDLDGLDPHDAPGVGTPVIGGISYREGHVSLEMLADADILCSAEFVEVNPILDRENMTARVAVALMSSVFGDKLL

SEQ ID NO: 111 - protein, 306 aa, Brucella melitensis; identical to SEQ ID NO: 100

SEQ ID NO: 112 - protein, 327 aa, Agrobacterium tumefaciens; identical to SEQ ID NO: 98

SEQ ID NO: 113 - protein, 324 aa, Agrobacterium tumefaciens
MNGAGEINASRHRKENELKTCQILGAPVQSGASQPGCLMGPDAFRTAGLTQVLTELGWAVTDLGDATPTVEPELSHPNSAVKNLDALVGWTRSLSQKALEMARSCDLPVFLGGDHSMSAGTVSGVAQRTAELGKEQFVLWLDAHTDLHTLHTTASGNLHGTPVAYYTGQSGFEGLPPLAAPVNPRNVSMMGIRSVDPEERRRVAEIGVQVADMRVLDEQGVVRPLEAFLDRVSKVSGRLHVSLDVDFLDPAIAPAVGTTVPGGATFREAHLIMEMLHDSGLVTSLDLAELNPFLDERGRTARLITDLASSLFGRRVFDRVTTAF

SEQ ID NO: 114 - DNA, 30 bp, Lycopersicon esculentum
ggaattccatatgaggagtgctggaagaat

SEQ ID NO: 115 - DNA, 30 bp, Lycopersicon esculentum
ccgctcgagcttggatatcttggcagtaag

SEQ ID NO: 116 - DNA, 30 bp, Lycopersicon esculentum
ggaattccatatgaagagtgctggaagtat

SEQ ID NO: 117 - DNA, 30 bp, Lycopersicon esculentum
ccgctcgagcttggacatcttggcagcaag

SEQ ID NO: 118 - protein, 8 aa, Lycopersicon esculentum
LEHHHHHH

SEQ ID NO: 119 - DNA, 21 bp, Lycopersicon esculentum
ccccttcacaagagaagaaat

SEQ ID NO: 120 - DNA, 21 bp, Lycopersicon esculentum
ttctgattatcctacaactgc

SEQ ID NO: 121 - DNA, 233 bp, Lycopersicon esculentum
ccccttcacaagagaaatggattggcttaatcagtcggtgattacgtgtaaattgtgctaatctccgttgcctaataacaatatttccattttcatactccacccgctgcaagcaccaaatcccattatattactactaaaaacgactgcatgtcttcttcttttttaaactcagcgattgccttctttttttgctctcatcactctttcttgcagttgtaggataatcagaa

SEQ ID NO: 122 - DNA, 18 bp, Lycopersicon esculentum
ccccttcacaagagaaat

SEQ ID NO: 123 - DNA, 21 bp, Lycopersicon esculentum
gcagttgtaggataatcagaa

SEQ ID NO: 124 - DNA, 21 bp, Lycopersicon esculentum
caagcaagaagtaccatgtat

SEQ ID NO: 125 - DNA, 20 bp, Lycopersicon esculentum
taatacgactcactataggg

SEQ ID NO: 126 - DNA, 20 bp, Lycopersicon esculentum
attaaccctcactaaaggga

SEQ ID NO: 127 - DNA, 349 bp, Lycopersicon esculentum
caagcaagaagtaccatgtatcctattagtgtactcatctttatgcgaaaataagtgtttattcacattaggtaggtctggcagatgctcagtttcctatggcaagggggattgggattatctgtaaacttgcctcccaaaataagctagtatatttgcagttccttatgagtaacctgttgttgtaagtgacacttgtatcatttggtatggagtttgttgtgtatggatgttttgaatcttaaaaaaaaaaaaaaaaaaaaaaaaaaaaaaaaaaaaaaaaaaaaaaaaaaaaaaaaaactcgagggggggcccggtacccaattcgccctatagtgagtcgtatta

SEQ ID NO: 128 - DNA, 21 bp, Lycopersicon esculentum
caagcaagaagtaccatgtat

SEQ ID NO: 129 - DNA, 20 bp, Lycopersicon esculentum
ccctatagtgagtcgtatta

SEQ ID NO: 130 - DNA, 418 bp, Lycopersicon esculentum
tcaaatctttcagatctttctttgacaaacttcaaatcaccatcaatcatggcagcagaaggttctcagtttgatgctcgtcaattcgatgcaaaaatgacagaactgcttggtactgaacaacaggaattcttcacatcatatgatgaggttcacgacagttttgatgccatgggtttgcaagaaaatctcctgaggggcatctatgcctatggttttgagaagccatctgctattcagcaaaggggcattgttcctttttgcaagggccttgatgtcatccagcaggcacaatctggtactggaaagacggcaactttctgctctggaattctccagcagcttgattacagtttagttgagtgtcaggctctggttcttgcaccaacccgtgagcttgcacaacagattgagaaag

SEQ ID NO: 131 - DNA, 1033 bp, Lycopersicon esculentum
ggaattccatatgaggagtgctggaagaatgggaatccattatatgcagaaattgcacgcgtcaaatgttccaaaagaattggtggaaaaaggacagaatcgtgttatagaggcatctcttacacttattcgtgaaagagcaaaacttaagggagagcttgttcgtgctcttggaggtgctgtagcctcaacgtctcttcttggagttcctctgggacataactcttcatttctccaggggccagcatttgctcctcctcgtatacgagaggctatgtggtgtggcagtacaaactctacaactgaggaaggaaaagaattagatgatccacgcatcttaactgatgttggtgatgtgcctgtgcaagagttacgagatgcaggtgtagatgatgataggttaatgagtatcataagcgaatctgtcaagctagttatggaagagaatccattgcgccccttggtgttagggggtgatcactctatatcctatcctgttgtaagagctgtgtctgaaaagcttggagggcctattgatatccttcaccttgatgctcatcctgacatttatcatgcctttgaaggaaacaaatactcacatgcatcaagctttgcacggataatggagggtggttatgctcgacggcttttgcaagtgggaattagatcaattaataaagaaggtcgagaacaaggaaaaaggttcggtgtggagcaatatgaaatgcgaacattttcccaagaccgacaatttttggagaatctgaaacttggcgaaggtgtgaagggcgtgtatatctcagtggatgttgactgtatggatccagcatttgctcctggagtatctcatatagaaccaggaggtctctctttccgcgatgttctaaacatactgcataaccttcaagctgatgttgttggtgctgatgtggttgagttcaacccgcagcgtgatactgttgatggcatgactgcaatggttgctgcgaagctggtaagagaacttactgccaagatatccaagctcgagcgg

SEQ ID NO: 132 - DNA, 30 bp, Lycopersicon esculentum; identical to SEQ ID NO: 114

SEQ ID NO: 133 - DNA, 30 bp, Lycopersicon esculentum
cttactgccaagatatccaagctcgagcgg

SEQ ID NO: 134 - DNA, 1033 bp, Lycopersicon esculentum
ggaattccatatgaagagtgctggaagtatgggaatcaactatatgcagaaattgctaacgtcaaatgttccaaaagaagtagtcaaaagaggacaggatcgtgttgtagaggcatctcttacacttattcgtgaaagagcaaaacttaagggagagcttgttcgtggacttggaggtgcagtagcgtcaacgtcacttcttggaattcctctgggacacaactcttcatttctccagggccctgcatttgctcctcctcttatacgagaggctatttggtgtggcagtacaaactccacaactgaggaaggaaaaatattagatgatcaacgtgtcttaactgatgttggtgatctgccagtacaagagttacgagacacaggcatagatgacgataggttgatgagtacagtaagtgaatctgtcaagctagttatggacgagaatccattgcgccccttggtgttagggggtgatcactctatatcctatcctgttgtaagagctgtgtctgaaaagcttggaggacctgttgatatccttcaccttgatgctcatcctgacatttatgatgcatttgaaggaaacaaatactcacatgcatcaagctttgcacgaataatggagggtggttatgctcgacgccttttgcaagttggaattagatcaattaatctagaaggtcgagaacaaggaaaaaggtttggtgtggagcaatatgaaatgcgaacattttccagagacagacaatttttggagaatctgaaacttggtgaaggtgtaaagggcgtgtatatatccgtggatgttgactgtttggatccagcatttgctcctggagtatctcattttgagtcaggcggtctctcgttccgcgatgttctaaacatactgcataaccttcaaggtgatatcgttggtgctgatgtcgttgagtacaacccacagcgtgatactgctgatggcatgactgcaatggttgctgcgaagctggtaagagaacttgctgccaagatgtccaagctcgagcgg

SEQ ID NO: 135 - DNA, 30 bp, Lycopersicon esculentum; identical to SEQ ID NO: 116

SEQ ID NO: 136 - DNA, 30 bp, Lycopersicon esculentum
cttgctgccaagatgtccaagctcgagcgg

SEQ ID NO: 137 - DNA, 1508 bp, Lycopersicon esculentum; identical to SEQ ID NO: 2

SEQ ID NO: 138 - DNA, 252 bp, Lycopersicon esculentum
gcacgagggtccccttcacaagagaaatggattggcttaatcagtcggtgattacgtgtaaattgtgctaatctccgttgcctaataacaatatttccattttcatactccacccgctgcaagcaccaaatcccattatattactactaaaaacgactgcatgtcttcttcttttttaaactcagcgattgccttctttttttgctctcatcactctttcttgcagttgtaggataatcagaataaacaaat

SEQ ID NO: 139 - DNA, 239 bp, Lycopersicon esculentum
cctgcagtaatttctaaaattatgaaggaagaattaccatgcatccaatagagaccactagatttgtactcatctttactggggaggtttaacagagaataagcaccaaaatgaagtgtttattcaccttattgtaactctaaaactaaaagctatatttgcagttcattatgaggaccctgtgattcttataatcttttaagtggtgcaaaaaaaaaaaaaaaaaaaaaaaaaaaaaa

SEQ ID NO: 140 - DNA, 1360 bp, Lycopersicon esculentum; identical to SEQ ID NO: 1

SEQ ID NO: 141 - DNA, 19 bp, Lycopersicon esculentum
gttcttgtagtaaacaaat

SEQ ID NO: 142 - DNA, 324 bp, Lycopersicon esculentum
cctgcagtaattttcaattttaacaagcaagaagtaccatgtatcctattagtgtactcatctttatgcgaaaataagtgtttattcacattaggtaggtctggcagatgctcagtttcctatggcaagggggattgggattatctgtaaacttgcctcccaaaataagctagtatatttgcagttccttatgagtaacctgttgttgtaagtgacacttgtatcatttggtatggagtttgttgtgtatggatgttttgaatcttaaaaaaaaaaaaaaaaaaaaaaaaaaaaaaaaaaaaaaaaaaaaaaaaaaaaaaaaaa

SEQ ID NO: 143 - DNA, 1218 bp, Lycopersicon esculentum
tcccccgggggaggttcttgtagtaaacaaatatgaagagtgctggaagtatgggaatcaactatatgcagaaattgctaacgtcaaatgttccaaaagaagtagtcaaaagaggacaggatcgtgttgtagaggcatctcttacacttattcgtgaaagagcaaaacttaagggagagcttgttcgtggacttggaggtgcagtagcgtcaacgtcacttcttggaattcctctgggacacaactcttcatttctccagggccctgcatttgctcctcctcttatacgagaggctatttggtgtggcagtacaaactccacaactgaggaaggaaaaatattagatgatcaacgtgtcttaactgatgttggtgatctgccagtacaagagttacgagacacaggcatagatgacgataggttgatgagtacagtaagtgaatctgtcaagctagttatggacgagaatccattgcgccccttggtgttagggggtgatcactctatatcctatcctgttgtaagagctgtgtctgaaaagcttggaggacctgttgatatccttcaccttgatgctcatcctgacatttatgatgcatttgaaggaaacaaatactcacatgcatcaagctttgcacgaataatggagggtggttatgctcgacgccttttgcaagttggaattagatcaattaatctagaaggtcgagaacaaggaaaaaggtttggtgtggagcaatatgaaatgcgaacattttccagagacagacaatttttggagaatctgaaacttggtgaaggtgtaaagggcgtgtatatatccgtggatgttgactgtttggatccagcatttgctcctggagtatctcattttgagtcaggcggtctctcgttccgcgatgttctaaacatactgcataaccttcaaggtgatatcgttggtgctgatgtcgttgagtacaacccacagcgtgatactgctgatggcatgactgcaatggttgctgcgaagctggtaagagaacttgctgccaagatgtccaagtgacctgcagtaattttcaattttaacaagcaagaagtaccatgtatcctattagtgtactcatctttatgcgaaaataagtgtttattcacattaggtaggtctggcagatgctcagtttcctatggcaagggggattgggattatctgtaaacttgcctccccgagctcg

SEQ ID NO: 144 - DNA, 30 bp, Artificial sequence
  Synthetic
tcccccgggggaggttcttgtagtaaacaa

SEQ ID NO: 145 - DNA, 2 bp, Artificial sequence
  Synthetic
at

SEQ ID NO: 146 - DNA, 139 bp, Lycopersicon esculentum
cctgcagtaattttcaattttaacaagcaagaagtaccatgtatcctattagtgtactcatctttatgcgaaaataagtgtttattcacattaggtaggtctggcagatgctcagtttcctatggcaagggggattggg

SEQ ID NO: 147 - DNA, 30 bp, Artificial sequence
  Synthetic
attatctgtaaacttgcctccccgagctcg

SEQ ID NO: 148 - DNA, 1386 bp, Rattus norvegicus; identical to SEQ ID NO: 40

SEQ ID NO: 149 - protein, 323 aa, Rattus norvegicus; identical to SEQ ID NO: 90

SEQ ID NO: 150 - DNA, 543 bp, Bos taurus
gctgccaaagacattgtgtatattggtctgagagatgtggaccctggggaacactatattttgaaaactctgggaattaaatacttttcaatgactgaagtggataaactgggaattggcaaggtgatggaagaaacattcagctatctactaggaagaaagaaaaggccaattcatttgagctttgatgttgatggactggacccatctttcacgccagctactggcacaccagtccagggaggtctgacttacagagaaggtctctacatcacagaagaaatttacaaaacaggtttactctcaggattagatataatggaagtgaatccgtctctggggaagacaccagaagaagtgactcgaacagtgaacacaacagtagcaataaccatggcttgctttggggttgctcgagagggtaaccataaacctattgattaccttagcccaccaaagtaaacatggaatcatcatataaaaaagtctcacagctaaatgacataattagtaaatctaataaagttacagtcatcgtcccaa

SEQ ID NO: 151 - DNA, 23 bp, Cauliflower mosaic virus
ccttcgcaagacccttcctctat

SEQ ID NO: 152 - DNA, 22 bp, Lycopersicon esculentum
gacatcagcaccaaggatatca

SEQ ID NO: 153 - DNA, 1023 bp, Lycopersicon esculentum
ccttcgcaagacccttcctctatataaggaagttcatttcatttggagagaacacgggggactctagaggatccccgggggaggttcttgtagtaaacaaatatgaagagtgctggaagtatgggaatcaactatatgcagaaattgctaacgtcaaatgttccaaaagaagtagtcaaaagaggacaggatcgtgttgtagaggcatctcttacacttattcgtgaaagagcaaaacttaagggagagcttgttcgtggacttggaggtgcagtagcgtcaacgtcacttcttggaattcctctgggacacaactcttcatttctccagggccctgcatttgctcctcctcttatacgagaggctatttggtgtggcagtacaaactccacaactgaggaaggaaaaatattagatgatcaacgtgtcttaactgatgttggtgatctgccagtacaagagttacgagacacaggcatagatgacgataggttgatgagtacagtaagtgaatctgtcaagctagttatggacgagaatccattgcgccccttggtgttagggggtgatcactctatatcctatcctgttgtaagagctgtgtctgaaaagcttggaggacctgttgatatccttcaccttgatgctcatcctgacatttatgatgcatttgaaggaaacaaatactcacatgcatcaagctttgcacgaataatggagggtggttatgctcgacgccttttgcaagttggaattagatcaattaatctagaaggtcgagaacaaggaaaaaggtttggtgtggagcaatatgaaatgcgaacattttccagagacagacaatttttggagaatctgaaacttggtgaaggtgtaaagggcgtgtatatatccgtggatgttgactgtttggatccagcatttgctcctggagtatctcattttgagtcaggcggtctctcgttccgcgatgttctaaacatactgcataaccttcaaggtgatatcgttggtgctgatgtc

SEQ ID NO: 154 - DNA, 23 bp, Artificial sequence
  Synthetic
ccttcgcaagacccttcctctat

SEQ ID NO: 155 - DNA, 22 bp, Artificial sequence
  Synthetic
tgatatcgttggtgctgatgtc

SEQ ID NO: 156 - DNA, 76 bp, Artificial sequence
  Synthetic
ccttcgcaagacccttcctctatataaggaagttcatttcatttggagagaacacgggggactctagaggatcccc

SEQ ID NO: 157 - protein, 281 aa, Pinus taeda
TCLLGVPLGHNSSFLQGPAFAPPRIREAIWCGSTNSATEKGKELKDSRVLSDAGDVPIQEMRDCGIEDERLMKTVSDSVKIVMEEPPLRPLVLGGDHSISYPVVKAVTDHLGGPVDILHLDAHPDIYDAFEGNKYSHASSFARIMEGGHARRLLQVGIRSITKEGREQGKRFGVEQYEMHSFSKDRDFLENLKLGEGVKGVYISIDVDCLDPAFAPGVSHLEPGGLSFRGVMNLVQNLQGDIVAADVVEFNPQRDTVDGMTAMVAAKLVRELTSKMSKLAH

SEQ ID NO: 158 - DNA, 976 bp, Lycopersicon esculentum
attcaccacaacagatgagagtgattcgaagtagagcaatactgatagtgctttttctggtttctgcgtttgggttaagcgaacagggaaaatcaggaggattctgcagtgaagagatggctactcttggtggagttcatgattctcatggttcctcgcagaacagtgacgagatccatagccttgctaaatttgccgtagatgagcataataagaaggagaatgcaatgattgaattggccagagtagtgaaggcgcaagaacaaactgttgcaggtaaactgcaccacctcactcttgaggtcatggatgctggaaaaaagaaactctatgaggctaaggtctgggtcaaaccatggttgaattttaaggaacttcaagagttcaagcatgttgaagacgttcctacctttacttcttcagatctaggagttaagcaagtagagcagaacagtggattgaaatcagtgcctgtgcatgatcctgttgttgaagaagctgcagagcatgcaataaagaccatccagcagagatccaactctatacatccatataaactacaagagattgttcatgctaatgctgagatggctgatgattctacaaagcttcatttggtcatcaaaaccagcaggggagggaaggaagagaagttcaaagttcaagtgcagcacaataatgaaggtgcgttccacttgaatcgtatggagcctgacaactaagtttgggagatcctacgcctctttagatttctttagttcatctatggagctatggatctgtttcaagtataataagcatgtaaccagcacaatatttttactacttgcttttgttcatctgaagtttgtcttcatctagtggattactctgatccaccttaggttgagggcatctttgtcttgtgtcacagttgtaatgtttcaagtattctgaacataactactcggtataaagtaaaaaaaaaaaaaaaaaa

SEQ ID NO: 159 - protein, 235 aa, Lycopersicon esculentum
MRVIRSRAILIVLFLVSAFGLSEQGKSGGFCSEEMATLGGVHDSHGSSQNSDEIHSLAKFAVDEHNKKENAMIELARVVKAQEQTVAGKLHHLTLEVMDAGKKKLYEAKVWVKPWLNFKELQEFKHVEDVPTFTSSDLGVKQVEQNSGLKSVPVHDPVVEEAAEHAIKTIQQRSNSIHPYKLQEIVHANAEMADDSTKLHLVIKTSRGGKEEKFKVQVQHNNEGAFHLNRMEPDN

SEQ ID NO: 160 - DNA, 1023 bp, Petunia x hybrida
acgaggactttggttagtccaatatttaagaaggaaagaaaaaagatagagtacagtttacagatgagagtaaatcgaaacgcaacagtgtttattgctttgaatctgattctgtttttagtttttgtgttcactgcgtttgcattaagcggtcaagaaaatacagggggattttgtggggaagaagaagaaaaaggaaataattatatagagatggctttacttggtggaattcgtgattcgcatcctgagtctcagaacagtgatgagatccatagccttgctaaatttgctgttgatgaacacaacaagaaggagaatgctatgtttgagctggccagagttgtgaaggcgaaagagcaagttgttgctggtacactgcatcatctgaccctcgaggtcgtagatgctggaaaaaagaaactctatgaagctaaggtctgggtcaaaccgtggttgaatttcaaggaacttcaagagttcacacacgttgaagatgctccagcaattacttcatcagatctaggtgttaagaaagaagagcaatgctctggattcaaatcagtgccggtacatgatccggttgtgcaagaagctgctgagcatgcaattaagaccatccagcagagatccaactcacttcttccatatgaacttcaagagattgttcatgcaaatgctgagatgattgaggactctacaaagctccatatgctcatcaaaaccagcaggggagggaaggaagagaagttcaaagttcaagtgcaccacagcaacgaaggtgctttccacttgaatcatatggagcctgatcgctcataactcttgaactagtattggaggtcctttacctcttcaaagtgctaagaaatgttccactatggaaagctatgagagagtgcatgaactccctttaaaagtaaataagcttgtaaaccagcacaacatttaaatttctgcctgtactttattatctgaagttggattctctgcttctaaagttctaaaaaaaaaaaaaaaaaa

SEQ ID NO: 161 - protein, 252 aa, Petunia x hybrida
MRVNRNATVFIALNLILFLVFVFTAFALSGQENTGGFCGEEEEKGNNYIEMALLGGIRDSHPESQNSDEIHSLAKFAVDEHNKKENAMFELARVVKAKEQVVAGTLHHLTLEVVDAGKKKLYEAKVWVKPWLNFKELQEFTHVEDAPAITSSDLGVKKEEQCSGFKSVPVHDPVVQEAAEHAIKTIQQRSNSLLPYELQEIVHANAEMIEDSTKLHMLIKTSRGGKEEKFKVQVHHSNEGAFHLNHMEPDRS

SEQ ID NO: 162 - protein, 595 aa, Lycopersicon esculentum
MEFLCLAPTRSFSTNPKLTKSIPSDHTSTTSRIFTYQNMRGSTMRPLALPLKMSPIVSVPDITAPVENVPAILPKVVPGELIVNKPTGGDSDELFQYLVDILASPVYDVAIESPLELAEKLSDRLGVNFYIKREDKQRVFSFKLRGAYNMMSNLSREELDKGVITASAGNHAQGVALAGQRLNCVAKIVMPTTTPQIKIDAVRALGGDVVLYGKTFDEAQTHALELSEKDGLKYIPPFDDPGVIKGQGTIGTEINRQLKDIHAVFIPVGGGGLIAGVATFFKQIAPNTKIIGVEPYGAASMTLSLHEGHRVKLSNVDTFADGVAVALVGEYTFAKCQELIDGMVLVANDGISAAIKDVYDEGRNILETSGAVAIAGAAAYCEFYKIKNENIVAIASGANMDFSKLHKVTELAGLGSGKEALLATFMVEQQGSFKTFVGLVGSLNFTELTYRFTSERKNALILYRVNVDKESDLEKMIEDMKSSNMTTLNLSHNELVVDHLKHLVGGSANISDEIFGEFIVPEKAETLKTFLDAFSPRWNITLCRYRNQGDINASLLMGFQVPQAEMDEFKNQADKLGYPYELDNYNEAFNLVVSE

SEQ ID NO: 163 - protein, 314 aa, Triticum aestivum
KMSPIVSVPDITAPVENVPAILPKPTGGDSDELFQYLVDILASPVYDVAIESPLELAEKGAYNMMSNLSREELDKGVITASAGNHAQGVALAGQRIVMPTTTPQIKALGGDVVLYGKTFDEAQTHALELSEKDGLKPPFDDPGVIKGQGTIGTEINRQLKDIHAVFIPVGGGGLIAGVATFFKQIAPNTKIIGVEPYGAASMTLSLHEGHRLSNVDTFADGVAVALVGEYTFAKCQELIDGMVLVANDGISAAIKDVYDEGRNILETSGAVAIAGAAAYCEFYKIKNENIVAIASGANMDFSKVTELAGLGSGK

SEQ ID NO: 164 - protein, 454 aa, Lycopersicon esculentum
KMSPIVSVPDITAPVENVPAILPKLGVNFYIKRLRGAYNMMSNLSREELDKGVITASAGNHAQGVALAGQRIVMPTTTPQIKALGGDVVLYGKTFDEAQTHALELSEKDGLKYIPPFDDPGVIKGQGTIGTEINRQLKDIHAVFIPVGGGGLIAGVATFFKQIAPNTKIIGVEPYGAASMTLSLHEGHRVKLSNVDTFADGVAVALVGEYTFAKCQELIDGMVLVANDGISAAIKDVYDEGRNILETSGAVAIAGAAAYCEFYKIKNENIVAIASGANMDFSKLHKVTELAGLGSGKEALLATFMVEQQGSFKTFVGLVGSLNFTELTYRVNVDKESDLEKMIEDMKSSNMTTLNLSHNELVVDHLKHLVGGSANISDEIFGEFIVPEKAETLKTFLDAFSPRYRNQGDINASLLMGFQVPQAEMDEFKNQADKLGYPYELDNYNEAFNLVVSE

SEQ ID NO: 165 - protein, 346 aa, Staphylococcus aureus subsp. aureus Mu50
MTTNTVTLQTAHIVSLGDIEEAKASIKPFIRRTPLIKSMYLSQNITKGNVYLKLENMQFTGSFKFRGASNKINHLSDEQKAKGIIGASAGNHAQGVALTAKLLGIDATIVMPETAPIAKQNATKGYGAKVILKGKNFNETRLYMEELAKENGMTIVHPYDDKFVMAGQGTIGLEILDDIWNVNTVIVPVGGGGLIAGIATALKSFNPSIHIIGVQAENVHGMAESFYKRALTEHREDSTIADGCDVKVPGEKTYEVVKHLVDEFILVSEEEIEHAMQDLMQRAKIITEGAGALPTAAILSGKIDKKWLEGKNVVALVSGGNVDLTRVSGVIEHGLNIADTSKGVVG

SEQ ID NO: 166 - protein, 576 aa, Saccharomyces cerevisiae
MSATLLKQPLCTVVRQGKQSKVSGLNLLRLKAHLHRQHLSPSLIKLHSELKLDELQTDNTPDYVRLVLRSSVYDVINESPISQGVGLSSRLNTNVILKREDLLPVFSFKLRGAYNMIAKLDDSQRNQGVIACSAGNHAQGVAFAAKHLKIPATIVMPVCTPSIKYQNVSRLGSQVVLYGNDFDEAKAECAKLAEERGLTNIPPFDHPYVIAGQGTVAMEILRQVRTANKIGAVFVPVGGGGLIAGIGAYLKRVAPHIKIIGVETYDAATLHNSLQRNQRTPLPVVGTFADGTSVRMIGEETFRVAQQVVDEVVLVNTDEICAAVKDIFEDTRSIVEPSGALSVAGMKKYISTVHPEIDHTKNTYVPILSGANMNFDRLRFVSERAVLGEGKEVFMLVTLPDVPGAFKKMQKIIHPRSVTEFSYRYNEHRHESSSEVPKAYIYTSFSVVDREKEIKQVMQQLNALGFEAVDISDNELAKSHGRYLVGGASKVPNERIISFEFPERPGALTRFLGGLSDSWNLTLFHYRNHGADIGKVLAGISVPPRENLTFQKFLEDLGYTYHDETDNTVYQKFLKY

SEQ ID NO: 167 - protein, 514 aa, Salmonella enterica subsp. enterica serovar Choleraesuis str.
MAESQPLSVAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKSLIVMPKATADIKVDAVRGFGGEVLLHGANFDEAKAKAIELAQQQGFTWVPPFDHPMVIAGQGTLALELLQQDSHLDRVFVPVGGGGLAAGVAVLIKQLMPQIKVIAVEAEDSACLKAALEAGHPVDLPRVGLFAEGVAVKRIGDETFRLCQEYLDDIVTVDSDAICAAMKDLFEDVRAVAEPSGALALAGMKKYIAQHNIRGERLAHVLSGANVNFHGLRYVSERCELGEQREALLAVTIPEEKGSFLKFCQLLGGRMVTEFNYRFADAKNACIFVGVRVSQGLEERKEIITQLCDGGYSVVDLSDDEMAKLHVRYMVGGRPSKPLQERLYSFEFPESPGALLKFLHTLGTHWNISLFHYRSHGTDYGRVLAAFELGDHEPDFETRLHELGYECHDESNNPAFRFFLAG

SEQ ID NO: 168 - protein, 514 aa, Escherichia coli K12 [sequence omitted]

SEQ ID NO: 169 - protein, 329 aa, Escherichia coli K12
MHITYDLPVAIDDIIEAKQRLAGRIYKTGMPRSNYFSERCKGEIFLKFENMQRTGSFKIRGAFNKLSSLTDAEKRKGVVACSAGNHAQGVSLSCAMLGIDGKVVMPKGAPKSKVAATCDYSAEVVLHGDNFNDTIAKVSEIVEMEGRIFIPPYDDPKVIAGQGTIGLEIMEDLYDVDNVIVPIGGGGLIAGIAVAIKSINPTIRVIGVQSENVHGMAASFHSGEITTHRTTGTLADGCDVSRPGNLTYEIVRELVDDIVLVSEDEIRNSMIALIQRNKVVTEGAGALACAALLSGKLDQYIQNRKTVSIISGGNIDLSRVSQITGFVDA

SEQ ID NO: 170 - protein, 311 aa, Thermus thermophilus
MPSLQDLYAAFRRIAPYTHRTPLLTSRLLDGLLGKRLLLKAEHLQKTGSFKARGALSKALALENPKGLLAVSSGNHAQGVAYAAQVLGVKALVVMPEDASPYKKACARAYGAEVVDRGVTAKNREEVARALQEETGYALIHPFDDPLVIAGQGTAGLELLAQAGRMGVFPGAVLAPVGGGGLLAGLATAVKALSPTTLVLGVEPEAADDAKRSLEAGRILRLEAPPRTRADGVRTLSLGERTFPILRERVDGILTVSEEALLEAERLLFTRTKQVVEPTGALPLAAVLEHGARLPQTLALLLSGGNRDFSP

SEQ ID NO: 171 - protein, 589 aa, Cicer arietinum
MLSTSTTNSSILPFRSRASSSTFIARPPANFNSIFTTSVRVFPISMSRYCVFPHTWERDHNVPGVPGVLRKVVPAAPIKNKPTCADSDELPEYLRDVLRSPVYDVVVESPVELTERLSDRLGVNFYVKREDRQRVFSFKLRGPYNMMSSLSHEEIDKGVITASAGNHAQGVPFPFPGRRLKCVAKIVMPTTTPNIKLDGVRALGADVVLWGHTFDEAKTHAVELCEKDGLRTIPPFEDPVIKGQGTIGSEINRQIKRIDAVFVPVGGGGLIAGVAAFFKQIAPQTKIIVVEPYDAASMALSVHAEHRAKLSNVDTFADGATVAVIGEYTFARCQDVVDAMVLVANDGIGAAIKDVFDEGRNIVETSGAAGIAGMYCEMYRIKNDNMVGIVSGANMNFRKLHKVSELAVLGSGHEALLGTYMPGQKGCFKTMAGLVHGSLSFTEITYRFTSHRRSILVLMLKLEPWRYIEKMIEMMKYSGVTVLNISHNELAVIHGKHLVGGSAKVSDEVFVEFIIPEKADLKKFLEVLSPHWNLTLYRYRNQGDLKATILMVIASFLCEIVIRKNQIDDLGYPYEIDQYNDAFNLAVTE

SEQ ID NO: 172 - protein, 601 aa, Nicotiana attenuata
MEVLCQAPAGNSNFACNPKFTAIRTRAISSNDTFKVISSTGNNKKMKGAIRTSIPKPSALPLKVSQLSPSADSMPVPASLQDVEAGKLIENNPSGGDTEELFQYLVEILASRVYDVAIDSPLQNAAKLSKKLGVNFWIKREDMQSVFSFKLRGAYNMMTKLSKEQLERGVITASAGNHAQGVALGAQRLKCTATIVMPVTTPEIKIEAVKNLDGKVVLHGDTFDKAQEHALKLAEDEGLTFIPPFDHPDVIIGQGTIGTEINRQLKDIHAVFVPVGGGGLIAGVAAYFKRVAPHTKIIGVEPFGASSMTQSLYHGERVKLEQVDNFADGVAVALVGEETFRLCKDLIDGMVLVSNDAISAAVKDVYDEGRNILETSGALAIAGAEAYCKYYNIKGENVVAIASGANMDFSKLKLVVDLADIGGQREALLATFMPEEPGSFKKFCELVGPMNITEFKYRYNSGRKQALVLYSVGVNTKSDLESMLERMKSSQLNTVNLTNNNLVKEHLRHLMGGRSEPSNEIFCQFIFPEKPGALRKFLDAFSPRWNISLFHYREQGELDASVLVGFQVPKGEIEEFRVQANNLGYSYEIESLNEASQLIME

SEQ ID NO: 173 - protein, 592 aa, Arabidopsis thaliana
MNSVQLPTAQSSLRSHIHRPSKPVVGFTHFSSRSRIAVAVLSRDETSMTPPPPKLPLPRLKVSPNSLQYPAGYLGAVPERTNEAENGSIAEAMEYLTNILSTKVYDIAIESPLQLAKKLSKRLGVRMYLKREDLQPVFSFKLRGAYNMMVKLPADQLAKGVICSSAGNHAQGVALSASKLGCTAVIVMPVTTPEIKWQAVENLGATVVLFGDSYDQAQAHAKIRAEEEGLTFIPPFDHPDVIAGQGTVGMEITRQAKGPLHAIFVPVGGGGLIAGIAAYVKRVSPEVKIIGVEPADANAMALSLHHGERVILDQVGGFADGVAVKEVGEETFRISRNLMDGVVLVTRDAICASIKDMFEEKRNILEPAGALALAGAEAYCKYYGLKDVNVVAITSGANMNFDKLRIVTELANVGRQQEAVLATLMPEKPGSFKQFCELVGPMNISEFKYRCSSEKEAVVLYSVGVHTAGELKALQKRMESSQLKTVNLTTSDLVKDHLRYLMGGRSTVGDEVLCRFTFPERPGALMNFLDSFSPRWNITLFHYRGQGETGANVLVGIQVPEQEMEEFKNRAKALGYDYFLVSDDDYFKLLMH

SEQ ID NO: 174 - protein, 406 aa, Arabidopsis thaliana
MENLEIPSFDEIIEAQRYLEGKVNRTPLIRSTTIGKEYGADIYFKLENFQKTGSFKSRGAIFRFSKLSEDEKRHGVITASAGNHAQGVAYAAMINGIDAKIVMPEYTIPQKVNAVISYGAHVILKGSDYDEAHRYADEIAKQEGRIFIEAFNDRWVISGQGTIGLEIMEDLPDVDIILVPVGGGGLISGIALAAKHASNKVKVIGIESELSDSMKASLREGKIVAHTSGVSICDGISVKYPGVLTFDIARKYVDDIVTVTEEYVSKAIYKLFERNKIVAEPSGAVGLAAIMEGKVDVKGKKVAIVVSGGNINPLLMSKIIYKELENLGQLVRIECTIPDRPGNLYRIAMAIAENGGNIYHAEVDNLRKETPPGFQSVTFTVNVRGQDHLDRIIGSLREMGYLFRIT

SEQ ID NO: 175 - protein, 304 aa, Agrobacterium tumefaciens
MERTPLVRSEFLSERCGHPVHLKLETLQPIGAFKLRGAMNAILSLDDAVRRRGLVTASTGNHGRAVAYAAAKLGIPATICMSALVPANKVEAIRMLGAEIRIVGRSQDDAQEEVERLTKNRGLTAIPPFDHADVVAGQGTIGLEVVEDMPELATILVPLSGGGLAGGIAVAVKALKPRARVIGISMERGAAMHASVKAGRPVSVCEEETLADSLGGGIGLANRVTFALCKTLLDEIVLVSEDEIATGICHASREEDLRVEGAGAVGFAAILAGKIAVSGPAAIIVSGGNIDPAVHKTIIDGGVA

SEQ ID NO: 176 - protein, 519 aa, Photorhabdus luminescens
MAACLPLTSSPNGAEYLKAALSAPVYEVAQVTPLQEMEKISARLGNTILVKREDRQPVHSFKLRGAYAMIASLTEEQKNRGVITASAGNHAQGVALSANRLGINSLIVMPVTTADIKVDAVRSFGGKALLYGANFDEAKAKAIEMAQQEGYTFVPPFDHPAVIAGQATLAMELLQQDVRLDRIFVPVGGGGLIAGVAVLIKQLMPEIKIIGVEAEDSACLKAAMEAGHPVDLPRVGLFAEGVAVKRIGDETFRLCQQYVDDVITVDSDAICAAVKDLFEDVRAIAEPSGALALAGLKKYVQQHQLRGERLAHILSGANVSFHGLRYVSERCELGEQREALLAVTIPEQKGSFLSFCQKLGDRVVTEFNYRYTDADPDQACLFVGVRLSRGEVERREIIEELRTAGYQVADLSDDEMAKLHVRYMIGGRPSKPLKERLFSFEFPESPGALLKFLQTLGTHWNITLFHYRNYGTDYGRVLAAFELSGAEVRFKRHLDALGYAYHDETDTPAFKFFLMCQNI

SEQ ID NO: 177 - protein, 422 aa, Bacillus subtilis
MKPLLKENSLIQVKHILKAHQNVKDVVIHTPLQRNDRLSERYECNIYLKREDLQVVRSFKLRGAYHKMKQLSSEQTENGVVCASAGNHAQGVAFSCKHLGIHGKIFMPSTTPRQKVSQVELFGKGFIDIILTGDTFDDVYKSAAECCEAESRTFIHPFDDPDVMAGQGTLAVEILNDIDTEPHFLFASVGGGGLLSGVGTYLKNVSPDTKVIAVEPAGAASYFESNKAGHVVTLDKIDKFVDGAAVKKIGEETFRTLETVVDDILLVPEGKVCTSILELYNECAVVAEPAGALSVAALDLYKDQIKGKNVVCVVSGGNNDIGRMQEMKERSLIFEGLQHYFIVNFPQRAGALREFLDEVLGPNDDITRFEYTKKNNKSNGPALVGIELQNKADYGPLIERMNKKPFHYVEVNKDEDLFHLLI

SEQ ID NO: 178 - protein, 594 aa, Lycopersicon esculentum
EFLCLAPTRSFSTNPKLTKSIPSDHTSTTSRIFTYQNMRGSTMRPLALPLKMSPIVSVPDITAPVENVPAILPKVVPGELIVNKPTGGDSDELFQYLVDILASPVYDVAIESPLELAEKLSDRLGVNFYIKREDKQRVFSFKLRGAYNMMSNLSREELDKGVITASAGNHAQGVALAGQRLNCVAKIVMPTTTPQIKIDAVRALGGDVVLYGKTFDEAQTHALELSEKDGLKYIPPFDDPGVIKGQGTIGTEINRQLKDIHAVFIPVGGGGLIAGVATFFKQIAPNTKIIGVEPYGAASMTLSLHEGHRVKLSNVDTFADGVAVALVGEYTFAKCQELIDGMVLVANDGISAAIKDVYDEGRNILETSGAVAIAGAAAYCEFYKIKNENIVAIASGANMDFSKLHKVTELAGLGSGKEALLATFMVEQQGSFKTFVGLVGSLNFTELTYRFTSERKNALILYRVNVDKESDLEKMIEDMKSSNMTTLNLSHNELVVDHLKHLVGGSANISDEIFGEFIVPEKAETLKTFLDAFSPRWNITLCRYRNQGDINASLLMGFQVPQAEMDEFKNQADKLGYPYELDNYNEAFNLVVSE

SEQ ID NO: 179 - protein, 576 aa, Saccharomyces cerevisiae
MSATLLKQPLCTVVRQGKQSKVSGLNLLRLKAHLHRQHLSPSLIKLHSELKLDELQTDNTPDYVRLVLRSSVYDVINESPISQGVGLSSRLNTNVILKREDLLPVFSFKLRGAYNMIAKLDDSQRNQGVIACSAGNHAQGVAFAAKHLKIPATIVMPVCTPSIKYQNVSRLGSQVVLYGNDFDEAKAECAKLAEERGLTNIPPFDHPYVIAGQGTVAMEILRQVRTANKIGAVFVPVGGGGLIAGIGAYLKRVAPHIKTIGVETYDAATLHNSLQRNQRTPLPVVGTFADGTSVRMIGEETFRVAQQVVDEVVLVNTDEICAAVKDIFEDTRSIVEPSGALSVAGMKKYISTVHPEIDHTKNTYVPILSGANMNFDRLRFVSERAVLGEGKEVFMLVTLPDVPGAFKKMQKIIHPRSVTEFSYRYNEHRHESSSEVPKAYIYTSFSVVDREKEIKQVMQQLNALGFEAVDISDNELAKSHGRYLVGGASKVPNERIISFEFPERPGALTRFLGGLSDSWNLTLFHYRNHGADIGKVLAGISVPPRENLTFQKFLEDLGYTYHDETDNTVYQKFLKY

SEQ ID NO: 180 - protein, 404 aa, Lycopersicon esculentum
MEFLCLAPTRSFSTNPKLTKSIPSDHTSTTSRIFTYQNMRGSTMRPLALPLKMSPIVSVPDITAPVENVPAILPKVVPGELIVNKPTGGDSDELFQYLVDILASPVYDVAIESPLELAEKLSDRLGVNFYIKREDKQRVFSFKLRGAYNMMSNLSREELDKGVITASAGNHAQGVALAGQRLNCVAKIVMPTTTPQIKIDAVRALGGDVVLYGKTFDEAQTHALELSEKDGLKYIPPFDDPGVIKGQGTIGTEINRQLKDIHAVFIPVGGGGLIAGVATFFKQIAPNTKIIGVEPYGAASMTLSLHEGHRVKLSNVDTFADGVAVALVGEYTFAKCQELIDGMVLVANDGISAAIKDVYDEGRNILETSGAVAIAGAAAYCEFYKIKNENIVAIASGANMDFSK

SEQ ID NO: 181 - protein, 353 aa, Lycopersicon esculentum
KMSPIVSVPDITAPVENVPAILPKVVPGELIVNKPTGGDSDELFQYLVDILASPVYDVAIESPLELAEKLSDRLGVNFYIKREDKQRVFSFKLRGAYNMMSNLSREELDKGVITASAGNHAQGVALAGQRLNCVAKIVMPTTTPQIKIDAVRALGGDVVLYGKTFDEAQTHALELSEKDGLKYIPPFDDPGVIKGQGTIGTEINRQLKDIHAVFIPVGGGGLIAGVATFFKQIAPNTKIIGVEPYGAASMTLSLHEGHRVKLSNVDTFADGVAVALVGEYTFAKCQELIDGMVLVANDGISAAIKDVYDEGRNILETSGAVAIAGAAAYCEFYKIKNENIVAIASGANMDFSK

SEQ ID NO: 182 - protein, 24 aa, Lycopersicon esculentum
KMSPIVSVPDITAPVENVPAILPK

SEQ ID NO: 183 - protein, 35 aa, Lycopersicon esculentum
PTGGDSDELFQYLVDILASPVYDVAIESPLELAEK

SEQ ID NO: 184 - protein, 36 aa, Lycopersicon esculentum
GAYNMMSNLSREELDKGVITASAGNHAQGVALAGQR

SEQ ID NO: 185 - protein, 11 aa, Lycopersicon esculentum
IVMPTTTPQIK

SEQ ID NO: 186 - protein, 30 aa, Lycopersicon esculentum
ALGGDVVLYGKTFDEAQTHALELSEKDGLK

SEQ ID NO: 187 - protein, 55 aa, Lycopersicon esculentum
PPFDDPGVIKGQGTIGTEINRQLKDIHAVFIPVGGGGLIAGVATFFKQIAPNTKI

SEQ ID NO: 188 - protein, 20 aa, Lycopersicon esculentum
IGVEPYGAASMTLSLHEGHR

SEQ ID NO: 189 - protein, 48 aa, Lycopersicon esculentum
LSNVDTFADGVAVALVGEYTFAKCQELIDGMVLVANDGISAAIKDVYD

SEQ ID NO: 190 - protein, 44 aa, Lycopersicon esculentum
EGRNILETSGAVAIAGAAAYCEFYKIKNENIVAIASGANMDFSK

SEQ ID NO: 191 - protein, 571 aa, Lycopersicon esculentum
MATLRVSSLFASSSSSLHSNPSVFTKYQSSPKWAFSFPVTPLCSKRSKRIVHCIAGDTLGLTRPNESDAPKISIGAKDTAVVQWQGDLLAIGATENDMARDENSKFKNPLLQQLDSELNGLLSAASSEEDFSGKSGQSVNLRFPGGRITLVGLGSSASSPTSYHSLGQAAAAAAKSSQARNIAVALASTDGLSAESKINSASAIATGVVLGSFEDNRFRSESKKSTLESLDILGLGTGPEIERKIKYAEHVCAGVILGRELVNAPANIVTPAVLAEEAKKIASTYSDVISVNILDAEQCKELKMGAYLAVAAAATENPPYFIHLCFKTPTKERKTKLALVGKGLTFDSGGYNLKVGARSRIELMKNDMGGAAAVLGAAKALGEIRPSRVEVHFIVAACENMISAEGMRPGDIVTASNGKTIEVNNTDAEGRLTLADALIYACNQGVEKIIDLATLTGAIMVALGPSVAGAFTPNDDLAREVVEAAEASGEKLWRMPMEESYWESMKSGVADMINTGPGNGGAITGALFLKQFVDEKVQWLHLDVAGPVWSDEKKNATGYGVSTLVEWVLRN

SEQ ID NO: 192 - protein, 220 aa, Lycopersicon esculentum
MMKCLFLLCLCLFPIVVFSSSFTSQNPIELPSASPKPNPVLDTNGNELNPNSSYRIISTFWGALGGDVYLGKSPRSSAPCLDGVFRYNSDVGTVGTPVRFIPLSGGIFEDQLMNLQFNIATVKLCVSYTIWKAGNLNAYYRAMLLETGGSIGQVDSSYFKIVKASTFGYNLLYCPITRPVLCPFCRGDDFCAKVGVINQDGRRRLALVNENPLGVYFKKV

SEQ ID NO: 193 - protein, 225 aa, Lycopersicon esculentum
MMKSLVLFVSIALCVPLALSSTFSSDLLLPSDEVVPNGKTYASVVDSDGNPVKAGAKYFVLPSLRGSGGGLVLSRVVDKNVKVCPQDIVQEPQELNTGRPVEFFPAYPNKTGEIIKVNNPINVNFFSLSKTSRCANFTVWKMDKKYKYVVGRGTLGALNRIRNWFRIVPYGKGYRFVYCPSLCVPCKIRCFDLFISYEERENVQVRRLAASDNELPFSVYFKKAD

SEQ ID NO: 194 - protein, 179 aa, Synechocystis 2
IILGGDHSIGFPTVRGICRHLGDKKVGIIHFDRHVDTQETDLDERMHTCPWFHATNMANAPAKNLVQLGIGGWQVPRQGVKVCRERATNILTVTDITEMSLDAAADFAIARATDGTDCVWISFDIDCIDAGFVPGTGWPEPGGLLPREALYLLKRIIRETNVCGMEVVEVSPPYDISDM

SEQ ID NO: 195 - protein, 165 aa, Escherichia coli
LSFGGDHFVTLPLLRAHAKHFGKMALVHFDAHTDTYANGCEFDHGTMFYTAPKEGLIDPNHSVQIGIRTEFDKDNGFTVLDACQVNDRSVDDVIAQVKQIVGDMPVYLTFDIDCLDPAFAPGTGTPVIGGLTSDRAIKLVRGLKDLNIVGMDVVEVAPAYDQSEI

SEQ ID NO: 196 - protein, 176 aa, Arthrobacter sp.
VTLGGDHTIALPLLRAAAERAGEPIAMLHFDAHLDTWDTYFGAEYTHGTPFRRAVEEGILDTEAISHVGTRGPLYGKKDLDDDHRFGFGIVTSADVYYQGVLETVAKIRDRIGNRPLYISVDIDVLDPAHAPGTGTPEAGGITSRELLEIIRGFRGMNLVGADVVEVAPAYDHAEI

SEQ ID NO: 197 - protein, 175 aa, Homo sapiens
LTLGGDHTITYPILQAMAKKHGPVGLLHVDAHTDTTDKALGEKLYHGAPFRRCVDEGLLDCKRVVQIGIRGSSTTLDPYRYNRSQGFRVVLAEDCWMKSLVPLMGEVRQQMGGKPIYISFDIDALDPAYAPGTGTPEIAGLTPSQALEIIRGCQGLNVMGCDLVEVSPPYDLSGN

SEQ ID NO: 198 - protein, 175 aa, Pseudomonas aeruginosa
LTLGGDHTITLPILRAIKKKHGKVGLVHVDAHADVNDHMFGEKIAHGTTFRRAVEEDLLDCDRVVQIGLRAQGYTAEDFNWSRKQGFRVVQAEECWHKSLEPLMAEVREKVGGGPVYLSFDIDGIDPAWAPGTGTPEIGGLTTIQAMEIIRGCQGLDLIGCDLVEVSPPYDTTGN

SEQ ID NO: 199 - protein, 175 aa, Pseudomonas aeruginosa
LSVGGDHLVTLPIFRALGRERPLGMVHFDAHSDTNDRYFGDNPYTHGTPFRRAIEEGLLDPLRTVQIGIRGSVYSPDDDAFARECGIRVIHMEEFVELGVEATLAEARRVVGDGPTYVSFDVDVLDPAFAPGTGTPEIGGMTSLQAQQLVRGLRGLDLVGADVVEVSPPFDVGGA

SEQ ID NO: 200 - protein, 170 aa, Hordeum vulgare
LVLGGDHSISYPVVRAVSEKLGGPVDILHLDAHPDIYDCFEGNTYSHASSFARIMEGGYARRLLQVGLRSITKEGREQGKRFGVEQYEMRTFSRDREKLENLKLGEGVKGVYVSVDVDCLDPAFAPGVSHIEPGGLSFRDVLNILQNLQGDVVAGDVVEFNPQRDTVDGM

SEQ ID NO: 201 - protein, 170 aa, Oryza sativa
LVLGGDHSISYPVVRAVSEKLGGPVDILHLDAHPDIYDAFEGNIYSHASSFARIMEGGYARRLLQVGIRSITKEGREQGKRFGVEQYEMRTFSKDREKLESLKLGEGVKGVYISVDVDCLDPAFAPGVSHIEPGGLSFRDVLNILHNLQGDVVAGDVVEFNPQRDTVDGM

SEQ ID NO: 202 - protein, 170 aa, Arabidopsis thaliana
LVLGGDHSISYPVVRAVSEKLGGPVDILHLDAHPDIYDCFEGNKYSHASSFARIMEGGYARRLLQVGIRSINQEGREQGKRFGVEQYEMRTFSKDRPMLENLKLGEGVKGVYISIDVDCLDPAFAPGVSHIEPGGLSFRDVLNILHNLQADVVGADVVEFNPQRDTVDGM

SEQ ID NO: 203 - protein, 170 aa, Lycopersicon esculentum
LVLGGDHSISYPVVRAVSEKLGGPIDILHLDAHPDIYHAFEGNKYSHASSFARIMEGGYARRLLQVGIRSINKEGREQGKRFGVEQYEMRTFSQDRQFLENLKLGEGVKGVYISVDVDCMDPAFAPGVSHIEPGGLSFRDVLNILHNLQADVVGADVVEFNPQRDTVDGM

SEQ ID NO: 204 - protein, 170 aa, Lycopersicon esculentum
LVLGGDHSISYPVVRAVSEKLGGPVDILHLDAHPDIYDAFEGNKYSHASSFARIMEGGYARRLLQVGIRSINLEGREQGKRFGVEQYEMRTFSRDRQFLENLKLGEGVKGVYISVDVDCLDPAFAPGVSHFESGGLSFRDVLNILHNLQGDIVGADVVEYNPQRDTADGM

SEQ ID NO: 205 - protein, 170 aa, Glycine max
LILGGDHSISYPVVRAISEKLGGPVDVLHFDAHPDLYDEFEGNYYSHASSFARIMEGGYARRLLQVGIRSINKEGREQAKKFGVEQFEMRHFSKDRPFLENLNLGEGAKGVYISIDVDCLDPGYAVGVSHYESGGLSFRDVMNMLQNLKGDIVGGDVVEYNPQRDTPDRM

SEQ ID NO: 206 - protein, 170 aa, Glycine max
LVLGGDHSISFPVIRAVSEKLGGPVDVLHLDAHPDNYDAFEGNIYSHASSFARVMEGDYVRRLLQVGIRSITAEGRAQAKKFGVEQYEMRTFSRDRPFLENLKLGEGVKGVYISIDVDCLDPAFAPGVSHIEPGGLSFRDVLNILHNLQGAVVAGDVVELNPQRDTDDGM

SEQ ID NO: 207 - protein, 170 aa, Arabidopsis thaliana
LVIGGDHSISYPVVRAVSEKLGGPVDILHLDAHPDIYDRFEGNYYSHASSFARIMEGGYARRLLQVGIRSINKEGREQGKRFGVEQYEMRTFSKDRQMLENLKLGEGVKGVYISIDVDCLDPAFAPGVSHIEPGGLSFRDVLNILHNLQGAVVAGDVVELNPQRDTDDGM

SEQ ID NO: 208 - protein, 170 aa, Pinus taeda
LVLGGDHSISYPVVKAVTDHLGGPVDILHLDAHPDIYDAFEGNKYSHASSFARIMEGGHARRLLQVGIRSITKEGREQGKRFGVEQYEMHSFSKDRDFLENLKLGEGVKGVYISIDVDCLDPAFAPGVSHLEPGGLSFRGVMNLVQNLQGDIVAADVVEFNPQRDTVDGM

SEQ ID NO: 209 - protein, 187 aa, Agrobacterium tumefaciens
IFLGGDHAISAGTVAGMARRVAETGRPFFVLWLDAHTDYHTLETTRSGNLHGTPVAYFSGRDGFSGYFPPLSHAVAEENIGMIGIRSVDPAERAALEKSGITVHDMRSIDEHGVAVILREFLARVQAANGLLHVSLDVDFLEPSIAPAVGTTVPGGATFREAHLVMEMLHDSGLVCSLDLVELNPFL

SEQ ID NO: 210 - protein, 195 aa, Neurospora crassa
LTLGGDHSIAIGTIAGSAKAIKERLGREIAVIWVDAHADINTPETSGSGNIHGMPVSFLTGLASEDKEEFFGWLKPDHLLSVKKLVYIGLRDVDPGEKRILRENGIKAFSMHDIDKHGIGRVMEMALGHIGNDTPIHLSFDVDALDPMWAPSTGTPVRGGLTLREGDFICECVHETGSLVAVDLVEVNPTLAAPN

SEQ ID NO: 211 - protein, 183 aa, Bacillus subtilis
LVLGGDHSIAIGTLAGTAKHYDNLGVIWYDAHGDLNTLETSPSGNIHGMPLAVSLGIGHESLVNLEGYAPKIKPENVVIIGARSLDEGERKYIKESGMKVYTMHEIDRLGMTKVIEETLDYLSACDGVHLSLDLDGLDPNDAPGVGTPVVGGISYRESHLAMEMLYDAGIITSAEFVEVNPIL

SEQ ID NO: 212 - protein, 184 aa, Bacillus caldovelox
LVLGGDHSIAIGTLAGVAKHYERLGVIWYDAHGDVNTAETSPSGNIHGMPLAASLGFGHPALTQIGGYSPKIKPEHVVLIGVRSLDEGEKKFIREKGIKIYTMHEVDRLGMTRVMEETIAYLKERTDGVHLSLDLDGLDPSDAPGVGTPVIGGLTYRESHLAMEMLAEAQIITSAEFVEVNPIL

SEQ ID NO: 213 - protein, 192 aa, Homo sapiens
VTLGGDHSLAIGTISGHARHCPDLCVVWVDAHADINTPLTTSSGNLHGQPVSFLLRELQDKVPQLPGFSWIKPCISSASIVYIGLRDVDPPEHFILKNYDIQYFSMRDIDRLGIQKVMERTFDLLIGKRQRPIHLSFDIDAFDPTLAPATGTPVVGGLTYREGMYIAEEIHNTGLLSALDLVEVNPQLATSE

SEQ ID NO: 214 - protein, 192 aa, Homo sapiens
LVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTP

SEQ ID NO: 215 - protein, 306 aa, Synechocystis PCC6803
MHSPNKFTSGPKQFLESEAITSYADAAVVVVPIPYEATTSYRKGCEHGPEAVLEASDQLEAYDEELGTSPCHDLGIYTCAPLADSNKHPALAGDAMVTEVCDGIAPFVEDGKFVVAIGGEHAITTGVVRAMQRGTSEPFTVVQIDAHGDMRDKFEGSCHNHACVMRRVLELGLPTLPIAIRAICQEEADLIREKNIPVFWAREMADNPNWINEAIASITTQKVFLTIDMDGFDPGFMPGVGTPEPGGLGWYEGLNFFRRLFQTKQVIGCDLMELAPVRGSVVSEFSTAKLAYKLMGYWGESQRKKL

SEQ ID NO: 216 - protein, 303 aa, Trichodesmium erythraeum
MSTIYSTLLLPFIGSEIEPDYTTAKVVIVPIPYEATTTYRRGCVNGPAVLLNASQQLECYDEELDRETGLEVGIYTHEPIADTRNGKKITPLDMLKVTQETVEKLVSDGKFVIAIGGEHSITNGIVKAYKKLYFDEPFTVIQIDAHGDLRYEYEGSIYNHACVMRRIFEMGLPMVQIGIRAICKEEADLIKDKNLTVFKAREIAIQPDWMERVISSIQTKNVFLTIDLDGIDPTLIPGVGTPEPGGLNWYSLTTFLRRIFELYQVLGCDIMELAPITDSVVSEFTAAKLVYKLVGYQALAQDW

SEQ ID NO: 217 - protein, 296 aa, Magnetococcus sp. MC-1
MPNIPYPSFGETPPATLEEARVVILPLPYEGTVSYGTGTSQGPRAILEASKQLEVWDELHGREILPELPTHTLQPPSLENLNPEQVVQRIYATTLPHLQAGRMVVGLGGEHSVTEGVIKAYQTIHGNDFTVVQIDAHADLRNSYHDTPHSHACIMRRVWDMGLNAVQLGIRSISREEIRHVRYNGLNERIFWARDIVRWHRQNNTQWLDRMGALLKPKVFLTIDLDGFDPSVVPGTGTPEPGGLDWYMVGEIIDRITAQCEIIGFDITELAPIPNQQASEFLAARLVQRILGYIKP

SEQ ID NO: 218 - protein, 299 aa, Desulfovibrio desulfuricans
MSLCEHEERFLDSELEPVAPGKARFHIIPAGYEASVSYGGGTFRGPAAILAASRQLELWDGLSDPSRLGLFTHCPVDCDAETAEVLMRIEASVQAALDAAPENPPVPVLLGGEHTVTLGALRALYKRYGSFGVVQFDAHADLRERYDGTPYSHACVMRRALEMGLPLVQVGVRACSEEEVRVRTAHGVTCWDARQLAEHGLPEHILPPDFPSRVYVTFDVDGLDPAVIRATGTPVPGGLGWWDAQHMLRQAVEGRHVLGMDVVELAPDLGDIASDFAAAQLVYNMMGMVQRHAAAKGRV

SEQ ID NO: 219 - protein, 293 aa, Coxiella burnetii
MKCLPPEKAFLGLEPQKAVPYEKAKAVIIPFGLERSVSYGGGTAQGPAAMIEASFEVELFDEALWCEPYCDIGIVTLEEPKIEADMQSALKQLETLVQQVLDDEKFPFVFGGEHSITAGSIRPFVNAYDNLAILHFDAHADLRDGYEGEHYSHASAIRRCLDYPSVEVISVGIRNISAEEIPFFEANRNRIHIYWAKDKKTWDINEIIAPLKNRPIYLTFDLDGFDASLMPATGTPEPGGLFWNDAQEIITAAGQVGTIVGADINELAPIPGFHSCDFLAAKLAYKILSSAFK

SEQ ID NO: 220 - protein, 340 aa, Lycopersicon esculentum; identical to SEQ ID NO: 76

SEQ ID NO: 221 - protein, 341 aa, Hordeum vulgare; identical to SEQ ID NO: 75

SEQ ID NO: 222 - protein, 340 aa, Zea mays; identical to SEQ ID NO: 74

SEQ ID NO: 223 - protein, 340 aa, Oryza sativa; identical to SEQ ID NO: 77

SEQ ID NO: 224 - protein, 334 aa, Brassica napus; identical to SEQ ID NO: 67

SEQ ID NO: 225 - protein, 342 aa, Arabidopsis sp.; identical to SEQ ID NO: 60

SEQ ID NO: 226 - protein, 338 aa, Solanum tuberosum; identical to SEQ ID NO: 58

SEQ ID NO: 227 - protein, 338 aa, Lycopersicon esculentum; identical to SEQ ID NO: 55

SEQ ID NO: 228 - protein, 338 aa, Lycopersicon esculentum; identical to SEQ ID NO: 54

SEQ ID NO: 229 - protein, 350 aa, Glycine max; identical to SEQ ID NO: 65

SEQ ID NO: 230 - protein, 337 aa, Medicago truncatula
MSTIARRGIHYMQRLNSANVSSALLENGQNRVIDASLTLIRERAKLKGELVRALGGAVATSSLLGVPLGHNSSFLQGPAFAPPRIREAIWCGSTNSTTEEGKDLQDARVLTDVGDVPIQEIRDCGVDDHRLMNVIGESVKLVMEEDPLRPLVLGGDHSISFPVIRAVSEKLGGPVDVLHLDAHPDNYDEFEGNYYSHASSFARVMEGNYVRRLLQVGIRSITTEGRAQAKKFGVEQYEMRTFSRDRHFLENLKLGEGVKGVYISIDVDCLDPAFAPGVSHIEPGGLSFRDVLNILHNLQGDVVAGDVVEFNPQRDTVDGMTAMVAAKLVRELAAKIA

SEQ ID NO: 231 - protein, 320 aa, Glycine max
MSIITRRGIRYMPRLDAAKVSAALLEKGQNRVIDASLTLIRERAKLKGELVRALGGAKATSTLLGVPLGHNSSFLQGPAFAPPRIREAIWCGSTNSTTEEGKELQDARVLTDVGDVPIQEIRDCGVDDHRLMNVIGESVKLVMEEDPLCPLVLGGDHSISFPVIRAVSEKLGGPVDVLHLDAHPDNYDAFEGNIYSHASSFARVMEGDYVRRLLQVGIRSITAEGRAQAKKFGVEQYEMRTFSRDRPFLENLKLGEGVKGVYISIDVDCLDPAFAPGVSHIEPGGLSFRDVLNILHNLQGAVVAGDVVELNPQRDTDDGM

SEQ ID NO: 232 - protein, 344 aa, Arabidopsis sp.; identical to SEQ ID NO: 62

SEQ ID NO: 233 - protein, 341 aa, Pinus taeda
MGSMGKMVMRFLQKRSLATLPSQMIEKGQNRVVEASLTLIRERAKLKAELVQALGGSIATTCLLGVPLGHNSSFLQGPAFAPPRIREAIWCGSTNSATEKGKELKDSRVLSDAGDVPIQEMRDCGIEDERLMKTVSDSVKIVMEEPPLRPLVLGGDHSISYPVVKAVTDHLGGPVDILHLDAHPDIYDAFEGNKYSHASSFARIMEGGHARRLLQVGIRSITKEGREQGKRFGVEQYEMHSFSKDRDFLENLKLGEGVKGVYISIDVDCLDPAFAPGVSHLEPGGLSFRGVMNLVQNLQGDIVAADVVEFNPQRDTVDGMTAMVAAKLVRELTSKMSKLAH

SEQ ID NO: 234 - protein, 286 aa, Synechococcus WH8102
MTPFDSEGGIFMGSRRDPAGCRVGLFGVPYDGTTSFRPGTRFGPAAIREVSQGLETYCPQLDLDLEDLAYADLGAVDIPFGAPEPVVNAVQQATTAVLDLGLKPLMLGGEHSISSGAVAAVANQHPDLVLVQLDAHADLREEWLGTRHSHACAMRRCLEVLPSGDLLQLAIRSGTRSEFHELHSSGRRMDDVQALRDAMAPWTGRPIYLTVDLDWFDPAVLPGTGTPEPGGFLWGDFAAVVDVLSGHRLVAGDVVELAPQLDSSGVSSVLAAKVTRSLILLLGADQ

SEQ ID NO: 235 - protein, 304 aa, Prochlorococcus marinus
MPQNTTTTATRFDSEGAIFMAARRDPTGCNVGLFGVPYDGTSSFRPGSRFGPTAIRDVSNGLETYCPQLDLDLEDLAFTDLGALEIPCGDPKPVVEAVKKATQNVLKMGLRPLMLGGEHSISSGAVAAITELHSDLVLLQLDAHADLRQEYLGARHSHACAMRRCLEVLPSAQLLQFAIRSGTRAEFQELHDQQRLVNHNPGQAATELAKALAPHQGKPLYLTVDLDWFDPSVLPGTGTPEPGGFLWRDFAVVVDVLRHHQLVGADVVELAPQLDPSGMSSVLGAKVTRSLLMLLSLSTRSEQK

SEQ ID NO: 236 - protein, 290 aa, Bacillus anthracis
MRFDEAYSGKVFIKSHPSFEESEVVIYGMPMDWTVSYRPGSRFGPARIREVSIGLEEYSPYLDRELEEVKYFDAGDIPLPFGNAQRSLDMIEEYVSKLLDAGKFPLGLGGEHLVSWPIFKAMAKKYPDLAIIHMDAHTDLRESYEGEPLSHSTPIRKVCDLIGPENVYSFGIRSGMKEEFEWAKEVGMNLYKFDVLEPLKEVLPKLEGRPVYVTIDIDVLDPAHAPGTGTLEAGGITSKELLDSIVAIANSNINVVGADLVEVAPVYDHSDQTPVAASKFVREMLLGWVK

SEQ ID NO: 237 - protein, 290 aa, Bacillus cereus
MRFDEAYSGKVFIKSHPSFEESKVVIYGMPMDWTVSYRPGSRFGPARIREVSIGLEEYSPYLDRELEEVKYFDAGDIPLPFGNAQRSLDMIEEYVSKLLDADKFPLGLGGEHLVSWPIFKAMAKKYPDLAIIHMDAHTDLRESYEGEPLSHSTPIRKVCDLIGPENVYSFGIRSGMKEEFEWAKEVGMNLYKFDVLEPLKEVLPKLAGRPVYVTIDIDVLDPAHAPGTGTLEAGGITSKELLDSIVAIANSNINVVGADLVEVAPVYDHSDQTPVAASKFVREMLLGWVK

SEQ ID NO: 238 - protein, 290 aa, Bacillus subtilis
MRFDEAYSGKVFIASRPEWEEADAILYGMPMDWTVSYRPGSRFGPSRIREVSIGLEEYSPYLDRDLADLNFFDAGDIPLPFGNPQRSLDMIEEYVDSILEKGKFPMGMGGEHLVSWPVIKAMYKKYPDLAIIHFDAHTDLRVDYEGEPLSHSTPIRKAAELIGPHNVYSFGIRSGMKEEFEWAKENGMHISKFEVLEPLKEVLPKLAGRPVYVTIDIDVLDPAHAPGTGTVDAGGITSKELLASVHEIARSEVNVKGADLVEVAPVYDHSEQTANTASKIIREMLLGFVK

SEQ ID NO: 239 - protein, 289 aa, Clostridium thermocellum
MSLRNGNSTLPTKFMASIDSYDDASIVMAGVPMDFTCSFRPGTRFGPQKIREVSIGIEEYSVYMDRDLTQCSFFDAGDLDLPFGDVDKSLKLIGDVAEEILSDNKFPLFIGGEHLISVPVIKKVYEKYGPELIVVQFDAHADLREGYLGCPNSHASAVRRLIDFMPGKNIYQFGIRSGTKDEFEYAKKHTNMYTIDVFEPLSRVLDDIKDKPIYITLDIDVVDPAYANGTGTPEPGGISSRELLDSIHLFKGANLVGFDIVEVSPHYDQSDRTALLAAKIIREIIMMVG

SEQ ID NO: 240 - protein, 293 aa, Thermoanaerobacter tencongensis
MMRCKMGERVNFIDTGKFLTATKEYEEADIVLVGVPMDYSVSFKPGTRFGPSSIRQASYGLETYSVYLDRRLEDKKICDLGDLVLPYGNIEKSLRLIEEVAEKIVKDGKKGIFLGGEHLITYGILKSYIKKYGDKLAILHFDAHTDLREEFFDEPYSHATVLRKVWELSPKVKIYHFGIRSGEKEEFEFAEKNTNMFLYEVVEPLKNVMKEIKENFIYITFDIDVLDPAFAPGTGTPEPGGITAKEALEAIHLLKDFNVIGMDLVEVSPPYDVAGITSILAAKLVREAILSFF

SEQ ID NO: 241 - protein, 284 aa, Methanocaldococcus jannaschii
MEEHFIDLSKFMMANCPYEEAEGVIFSIPYDETTSFKPGAREGGNAIRTASWGLETYSPILDRDLAELKYCDLKDLDLYGSQEEIFGTIHSVSREILKENKKIIVFGGEHSITYPIIKAVKDIYDDFIVIQFDAHCDLRDEYLGNKLSHACVMRRVYELTKNIFQFGIRSGDKEEWDLARKNNLYLKMDLMNKDDLEYIKSLDKPIYVTIDIDVLDPAYAPGTGTPEPCGFSTRELFNSLYLLEEVKDKIIGFDIVEVSPIYDIANITAITAAKIARELMLMIL

SEQ ID NO: 242 - protein, 285 aa, Methanothermus fervidus
MGLKFAYSKDPSSLKYLSNKKVFGLLGVPFDSTSTYKPGSRFGPLMIRQASYNFENYSLHYRKKLDVPIIDLGDIEVILGDFKNTCRNISEKVQEVLKKGMIPIVLGGEHSITYGVVKTFDLSDVTILHFDAHMDMANTYAGKKFSHATVMRRIYELHPKKIVQIGVRSCTKEEHEFVLNENIKYYTSRDIIEKFNMVLNEINKLDGPFYVTVDIDVLDPGYAPGVGNPTPVGITPYHMEKFIEKIARKKIIGIDIVEVATDRIGDPAAMNAAKILYDFLFAIKI

SEQ ID NO: 243 - protein, 286 aa, Methanothermobacter thermautotrophicus
MLIHTHEPLKFAFSTTDHERIPELSFGIMGVPFDSTTSYVPGARFGPMAVREASYSFEAYNLRFSENVKVKSFDFGDLEVSPGNFMKTAGFIGDSVSEVLDMGLKPLIIGGEHTVTLPVIENLPEHDSLTVVHLDAHMDLADTYAGERYSHATVMRRVHELGAEIIQIGIRSASSEEAEFAGEEGVRFCMAHEVMGDPAGAIELIDGIRGPVYISVDMDVLDPAYAPSVGNPAPAGLTPHIMEELVLALSGKDVVGLDVVEVASGGMADPTSVNAAKIIYDILTLL

SEQ ID NO: 244 - protein, 295 aa, Sulfolobus tokodaii
MSDSRLLYLNENSRLFAGFNKPTSPFVIIGLPLDITSSFRPGSRFAPSTIREYAQFIEFYSIRTGIDMGEVGFNDVGDVVMHPSDVEENIRRISDVTSYFAEKGKIIIGIGGEHSVTVGTVRGIKPDCVLSIDAHLDLRDEYMGYKYDHACVMRRISEQGVKIMEIATRAVSKEELDYANKNGIAYLTPHQIRLLGVRETAKKIVNNFRDCEKIYVTYDMDGIDPAYAPGVATPEPEGLDPTTVLDIISLIIDKRVVGFDVVEVSPPHDPSGITSVLGARIILETSAQIYKARSL

SEQ ID NO: 245 - protein, 297 aa, Sulfolobus solfataricus
MSDGRLLYLNENSRKFAGFNKEKSPFVIIGIPMDITSSYRPGSRFAPSSIRESAQYIEFYSIRNDVDMGEIGFNDVGDIILHPSNVEENLSRISSVISYFQESGKITISIGGEHTITAGIIKGTKREGLCLVSFDAHLDLRDEYMGYRYDHACVMRRISEYGVKIIEVGTRAVSKEEIEYAKQKGILFFTPQQIRLLGVKETARRIITSTQECKSLYISVDMDGIDPAYAPGVATPEPDGLDPTNLLDIINLIADKRVIGFDIVEVSPSYDTSGITSVLASRIILETAATVYKARSL

SEQ ID NO: 246 - protein, 338 aa, Aeropyrum pernix
MGAIIVDGASRITALNPLTIYLSGGRVETGSRARDLYLLRPPEPVFGIQRSREESLFSVIGVPYDSTSSFRPGQRFAPREIRRASIELESNGYYVEGDIDRVPIADEGDVAAVPGSTLLTLERVARVVEDLAREGKVPVVLGGEHLVTLGALRGLAAAGVKPCVVVLDAHFDLRNDYLGERFSHATVFRRVLEELGVKLLYIGVRAYEAGEERLAVESGLIDYVPMRRMDIVGVDGAVLAARRFTGDCEKIYISIDMDFYDPAYAPGVGNPEPGGASSREGLALASQLGDRRVCGIDVVEVSPPYDPGGATSLLAAKTLQELLISVWQRWGVGRSASS

SEQ ID NO: 247 - protein, 291 aa, Methanosarcina barkeri
MFLPNSFIDALADYESARYVIFGVPFDNTSSYRAGSRWAPDAMRQASANFESYNPTFDIDLVDLPIYDAGNLETSALVDETLQNLYEATKDLLNDGKLPIMLGGEHSLTFAMVKACAELAGEDFGVLVLDAHFDLREEYRGFKYNHACVSRNILSEVTKNLVSIGIRSGPEEEWVFARENNLQYYTADDVESTGMVEILKEALEWLDCSQIYLSLDMDAIDPSYAPGLGTPEPFGLSARDVRTAIRTLAPFSMAFDVVEIAPEYDSGQTAMLGAKLMREFIASHAKSCRKA

SEQ ID NO: 248 - protein, 291 aa, Methanosarcina mazei
MFLPNSFIDALADYESARYVIFGVPFDNTSSYRAGSRWAPDAMRQVSANFESYNPVFDIDLVDLPIYDAGNLETSASVDETLRDLYEEVKALLNNGKLPIMLGGEHSLTYSTVKACAEFAGDDFGVLILDAHFDLREEYRGFKHNHACVSRNILENITDNLVSIGIRSGPEEEWIFARENKLKYYTADDVESIGMVEVLKEAIESLDCSQLYLSLDMDAIDPAYAPGLGTPEPFGLSARDVRTAIRTLAPYSMAFDVVEIAPEYDSGQTAMLGAKLMREFIASHAKSCIKK

SEQ ID NO: 249 - protein, 303 aa, Thermoplasma volcanium
MGGNGREKDHASELRSIFSLKKIADAVNGYEEAKYVVFGIPFDNTSSYRRGSKYAPDSIRGAYVNLESYEYSYGIDLLASGMADLGDMEESEDVEYVIDTVESVVSAVMSDGKIPIMLGGEHSITVGAVRALPKDVDLVIVDAHSDFRSSYMGNKYNHACVTRRALDLLGEGRITSIGIRSVSREEFEDPDFRKVSFISSFDVKKNGIDKYIEEVDRKSRRVYISVDMDGIDPAYAPAVGTPEPFGLADTDVRRLIERLSYKAVGFDIVEFSPLYDNGNTSMLAAKLLQVFIASREKYYKEHI

SEQ ID NO: 250 - protein, 283 aa, Pyrococcus abyssi
MLLYTYRSFDMELPTVSIEEADYVIMGLPFDGTTSYKPGARFGPVLIRQATLNLESYILDYDVDIAELKIADAGDVALPVNVEDAIKVGIEAIKELRSVNRKALPIFLGGEHSMTYPPVAVLKPKSYVVFDAHLDLRDSYQGSRFNHACVARRIHENGVEVAIFGVRSGTREEVKYATENGIEWVHARDYNFDAFVDLVASLSEPIYVSIDIDVFDIPLVPETGTPEPGGLRFWDVVNALEWLTERKNVVGFDIMEVSGDKLGNVTSITAAKLLFHILGMSSR

SEQ ID NO: 251 - protein, 321 aa, Pyrococcus furiosus
MKIQRKLLRQKVSFDFSFLLIKFLNSSLARLFGDDMLLHTYKSFDMELPLVNIKDADYVILGLPYDGTTSYKPGARFGPVLIRQATLNFESYILDYDVDLAEAKIADAGDVALPVSIEEALKVAEETVRELREINPKALPIFLGGEHSMTLAPVRVLKPKSYVVFDAHLDLRDSYGGSKFNHACVARRINELRVEVAIFGVRSGTKEEVDFARKNGIEWIHARDYSFEAFVDIVSTLPEPIYLSIDIDTFDASLVPETGTPEPGGLRFWDVVEALEWLSESREVIGIDIMEVGGEKLGNVTALTGAKLLFYLLGMFEGIKK

SEQ ID NO: 252 - protein, 275 aa, Archaeoglobus fulgidus
MHIDSYFSLSNCDAEEAEYLIYGIPYDATQSFKPGSRFAPNAIREASWNLESYSNLFDVELSLVKVGDAGNINCDGGFEQIVERTKEFLGEVEGFPVAIGGEHSISFAATSKFRKACFVVFDAHFDLRDEFDGDRFNHACTTRRIFESGMRVAIFGVRSGIKEEKRFAEENGIKYLHAWDFEVEKAVKMVEDFDKIYVSLDVDAFDPAFAPGVSTPEPFGLKPIDFIRFFAGIADRVVGFDVVEVVPDSNKVTQTLAAKIILEAIAAKVRCDIPK

SEQ ID NO: 253 - protein, 396 aa, Synechococcus WH8102
MSSPTDPNGAFQRSHPSEGTQALEKERKLPLTGWQQEVDQAKRLGLEAAESIVDRNISTFSRGELPHFAGINTFMKAPYLEDVNQVGNYDVAIVGVPHDCGTTYRPGTRFGPQGIRRISALYTPYNYEMGVDLREQITLCDVGDIFTIPANNEKSFDQISKGIAHVFASGAFPIILGGDHSIGFPTVRGVCRHLGDKKVGIIHFDRHVDTQEIDLDERMHTCPWFHATNMANAPAENLVQLGIGGWQVPREGVKVCHERGTNVLTVTDITEMGLEAAAQYAIERATDGTDCVYISFDIDCIDAGFVPGTGWPEPGGLLPREALKLLELIVRNVPVCGLEIVEVSPPYDISDMTSLMATRVICDAMAHLVVSGQLPRKDKPAWISDVCNMNVDQKWR

SEQ ID NO: 254 - protein, 390 aa, Synechocystis PCC6803
MSDATPFRPPSEAEEALIKETRLPLTGWQQEVDQGLTYGLEAAASIKDRSIPTFSRGELPHYAGINTFMKAPYLEDVREVGKYDVAIVGVPHDSGTTYRPGTRFGPQGIRRISALYTPYNFEMGVDLREQISLCDVGDIFTIPANNEKSFDQISKGIAHIFSSGAFPIILGGDHSIGFPTVRGICRHLGDKKVGIIHFDRHVDTQETDLDERMHTCPWFHATNMANAPAKNLVQLGIGGWQVPRQGVKVCRERATNILTVTDITEMSLDAAADFAIARATDGTDCVWISFDIDCIDAGFVPGTGWPEPGGLLPREALYLLKRIIRETNVCGMEVVEVSPPYDISDMTSLMATRVICDTMAHLVVSGQLPRTEKPAYIHAEANMAVDEPWQ

SEQ ID NO: 255 - protein, 311 aa, Vibrio vulnificus
MNDLFTKTDYSLYSNSMSFVRRPYVKDPVAADADLVVFGAPLDMATSGRPGARMGPDAIRRASVNLAWEGKKFPWDFNLFKKVKVIDGGDLVFDCGDAEDFTYRMEAATSAILKSGKTMLGLGGDHFITLPILRAYAKHYGEMALIHFDAHTDTYANGSSYDHGTMFYHAPKEGLISPKHSVQVGIRTEYKQEGHGFNVINAMQANDMSVEEILADIRRIVADKPVYVTFDIDCLDPAFAPGTGTPVCGGLNSDKILKIIRGLKDVNIVGMDVVEVSPPYDQSDLTALAGATIALELMYAWAANKEFESEF

SEQ ID NO: 256 - protein, 309 aa, Vibrio cholerae
MNDLFTKTDYSLYSNAMTFVRRPYVRNPVDTNADVVVLGVPLDMATSGRPGARMGPDAIRRASVNLAWEGKKFPWDFNLFKKINVIDAGDLVFDCGDAEDFTYRLEAATSEILKSGKTMLALGGDHFITLPILRAYAKHFGEMALIHFDAHTDTYANGSAYDHGTMFYHAPKEGLISAKHSVQVGIRTEYKQEGHGFNVINAMQANDMSVEEIVAQIRHIVGDKPVYLTFDIDCLDPAFAPGTGTPVCGGLSSDKILKIIRALKGINLIGMDVVEVSPPYDQSDLTSLAGATIALELLYVWASNKKDEE

SEQ ID NO: 257 - protein, 306 aa, Vibrio parahaemolyticus
MNDLFTKTDYSLYSNSMSFLRLPYIRNPVSADADVVVLGVPLDMATSGRPGARMGPDAIRRASVNLAWEGKKFPWDFNVLDKLKVIDAGDLVFDCGDAEDFTYRLEAATSEILKSGKTMLGLGGDHFITLPILRAYAKHHGQMALIHFDAHTDTYANGSSYDHGTMFYHAPKEGLISAKNSVQIGIRTEYKQQDHGFNVINAMQANDMSVNEILEEIRRTVADKPVYVTFDIDCLDPAFAPGTGTPVCGGLNSDKALKIIRGLAGMNIVGMDVVEVSPPYDHSDVTALAGATIALEMLYAYASGRE

SEQ ID NO: 258 - protein, 306 aa, Escherichia coli
MSTLGHQYDNSLVSNAFGFLRLPMNFQPYDSDADWVITGVPFDMATSGRAGGRHGPAAIRQVSTNLAWEHNRFPWNFDMRERLNVVDCGDLVYAFGDAREMSEKLQAHAEKLLAAGKRMLSFGGDHFVTLPLLRAHAKHFGKMALVHFDAHTDTYANGCEFDHGTMFYTAPKEGLIDPNHSVQIGIRTEFDKDNGFTVLDACQVNDRSVDDVIAQVKQIVGDMPVYLTFDIDCLDPAFAPGTGTPVIGGLTSDRAIKLVRGLKDLNIVGMDVVEVAPAYDQSEITALAAATLALEMLYIQAAKKGE

SEQ ID NO: 259 - protein, 307 aa, Neisseria meningitidis
MQYSTLAGQTDNSLVSNNFGFLRLPLNFMPYESHADWVITGVPYDMAVSGRSGARFGPEAIRRASVNLAWEHRRFPWTFDVRERLNIIDCGDLVFSFGDSRDFVEKMEAHAGKLLSSGKRCLSLGGDHFITLPLLRAHARYFGKLALIHFDAHTDTYDNGSEYDHGTMFYTAPKEGLIDPSRSVQIGIRTEHSKKLPFTVLSAPKVNEDSVEETVRKIKETVGNMPVYLTFDIDCLDPSFAPGTGTPVCGGLSSDRALKILRGLTDLDIVGMDVVEVAPSYDQSDITALAGATIALEMLYLQGAKKD

SEQ ID NO: 260 - protein, 322 aa, Burkholderia fungorum
MTELVYGDGAIRRASLYGSSIENTYAGVLSFMRRKYTRELDGVDVVVSGVPLDLATTFRSGARLGPAAVRAASVQLSELHPYPWGFNPFDDLAVTDYGDCWFDAHNPLTIKASIVEHARTILRSGAKMLTLGGDHYMTYPLLIAHAEKYGRPVSLIHFDAHCDTWADDSPDSLNHGSMFYKAVKDGLIDPETSVQIGIRTWNDDFMGINILDAAWVHEHGTRATVERIASIVGERPAYLTFDIDCLDPAFAPGTGTPVAGGLSSAQGLAIVRALGALNLVGADVVEVAPAYDQSEITAIAAAHIACDLLCLWRQRKVAQRGA

SEQ ID NO: 261 - protein, 323 aa, Nitrosomonas europaea
MSDDDQIRIDGAIARKTPYGMLREPTFSGMLSFMRCNFRKDLTGAELVISGIPLDLAVSYRSGARFGPLGIRQASAEVASLKPYPWGFDPFEHLAVIDSGDCFLDVHNPLTIHGAIVDHARHILASGARMLTFGGDHSISYPLLQAHVEKTGAPLSLIHFDAHCDTWPDDSLASLNHGSMFYKAVREGLIDVKRSVQIGIRTWNDDFMGINILDADRIHRQGTDAVVAEIERIVGTQPAYLTFDIDCLDPAYAPGTGTPVCGGLSTAQALAIIRGLTAINLIGMDIVEVSPPYDHSQITALAAAHIACDLICLLAKRKADGLL

SEQ ID NO: 262 - protein, 319 aa, Pseudomonas fluorescens
MDVPMQNDQALTRDSLFGTAAESTYAGITSFMRRRYSRDLRGADVAVSGVPFDTATSNRPGARFGPRGIRAASTGIAWERHWPWAFDPFDHLAVIDYGDCDFDYGSPHTIPDSIEAHAEHILSSGSAMLTFGGDHFISYPLLKAHARKHGTLSLIHFDAHSDTWPDEGGKRVDHGTMFWHAAREGLVDPARSVQIGLRTTNDDHQGFQVLDARQVHRCGCEAIIEAIRARVGDNPVYLTFDIDCLDPAFAPGTGTPVCGGLSTVQALEILGGLRGINLVGMDVVEVAPAYDHADVTSLAAATLAMEMLCLYAARHKVDA

SEQ ID NO: 263 - protein, 322 aa, Streptomyces coelicolor
MSSNETPRGPVDSSRIPRYAGPATFARLPRLDEVGAADVAVVGVPFDSGVSYRPGARFGGNAIREASRLLRPYNPAQDASPFALAQVADGGDIAVNPFNIHEAVETIEAAADDLLGTGARLMTLGGDHTIALPLLRSVAKKHGPVALLHFDAHLDTWDTYFGAEYTHGTPFRRAVEEGVLDTSALSHVGTRGPLYGKKDLTDDEKMGFGIVTSADVYRRGADEIADQLRQRIGDRPLYISIDIDCLDPAHAPGTGTPEAGGMTSRELLEILRGLASCNLVSADVVEVAPAYDHAEITSVAASHTAYELTTIMSRQIAEARTK

SEQ ID NO: 264 - protein, 322 aa, Streptomyces avermitilis
MSSNETPRGPVDSSRVPRYAGPATFARLPRLDEVGTADVAVVGVPFDSGVSYRPGARFGGNAIREASRLLRPYNPAQDASPFALAQVADAGDIAANPFNINEAVETVEAAADELLGTGARLMTLGGDHTIALPLLRSVAKKHGPVALLHFDAHLDTWDTYFGAEYTHGTPFRRAVEEGILDTEALSHVGTRGPLYGKQDLTDDEKMGFGIVTSADIYRRGADEVADQLRQRIGDRPLYISIDIDCLDPAHAPGTGTPEAGGMTSRELLEILRGLASCNLVSADVVEVAPAYDHAEITAVAASHTAYELTTIMSRQIAEARNK

SEQ ID NO: 265 - protein, 324 aa, Thermobifida fusca
MREGGNPVSTPIGPTDSSLVPRFAGPATFARLPRTDEVAKTDIAVVGIPFDSGVSYRPGARFGPAAIREASRLLRPYNPGLDVSPFAEVQVADGGDIAVNPFAIKEAIATVEASASELLSQGTRLVTLGGDHTIALPLLRAVHRVHGPVALLHFDAHLDTWDTYFGEPYTHGTPFRRAVEEGILDTEALTHVGIRGPLYGKKDLEDDRRFGFGIVTAADVMRRGVDEIADMVRQRIGNRPLYVSVDIDVLDPAHAPGTGTPEAGGLTSRELLELLRGLASCNLVGADVVEVSPAYDHAQITATAAAHVAYDLVSLLALTAKKDR

SEQ ID NO: 266 - protein, 353 aa, Arthrobacter KUJ8602
MEELRIEANGNLGPIDSSRIPRYAGAATYARLPRLDQVSKADVTVVGVPFDSGVSYRPGARFGANHVREASRLLRPYNPAWDVSPFENIQVADAGDMAVNPFNINEAIETIQQNALDLTANGSKLVTLGGDHTIALPLLRAAAERAGEPIAMLHFDAHLDTWDTYFGAEYTHGTPFRRAVEEGILDTEAISHVGTRGPLYGKKDLDDDHRFGFGIVTSADVYYQGVLETVAKIRDRIGNRPLYISVDIDVLDPAHAPGTGTPEAGGITSRELLEIIRGFRGMNLVGADVVEVAPAYDHAEITGVAGSHVAYELVTLMADNAVEGDRHGAPNGYAQQALGARIQEVAQAIGGQR

SEQ ID NO: 267 - protein, 352 aa, Homo sapiens
MLRLLASGCARGPGPGVGARPAAGLFHPGRRQSRQASDAPRNQPPSPEFVARPVGVCSMMRLPVQTSPEGLDAAFIGVPLDTGTSNRPGARFGPRRIREESVMLRTVNPSTGALPFQSLMVADLGDVNVNLYNLQDSCRQIQEAYEKIVAAGCIPLTLGGDHTITYPILQAMAKKHGPVGLLHVDAHTDTTDKALGEKLYHGAPFRRCVDEGLLDCKRVVQIGIRGSSTTLDPYRYNRSQGFRVVLAEDCWMKSLVPLMGEVRQQMGGKPIYISFDIDALDPAYAPGTGTPEIAGLTPSQALEIIRGCQGLNVMGCDLVEVSPPYDLSGNTALLAANLLFEMLCALPKVTTV

SEQ ID NO: 268 - protein, 340 aa, Gallus gallus; identical to SEQ ID NO: 89

SEQ ID NO: 269 - protein, 320 aa, Pseudomonas putida
MRPTVDKTLHQPLGGNEMPRFGGIATMLRLPHLQSAKGLDAAFIGVPLDIGTSLRSGTRFGPRQIRAESVMIRPYNMATGAAPFDSLSVADIGDVAINTFNLLDAVRIIEEAYDEIVEHNVIPMTLGGDHTITLPILRALHKKHGKIGLVHIDAHADVNDHMFGEKIAHGTTFRRAVEEGLLDCDRVVQIGLRAQGYTADDFNWSRRQGFRVVQAEECWHKSLEPLMAEVREKVGGGPVYLSFDIDGIDPAWAPGTGTPEIGGLTTIQAMEIIRGCHGLDLIGCDLVEVSPPYDTTGNTSLLGANLLFEMLCVLPGVVRR

SEQ ID NO: 270 - protein, 319 aa, Pseudomonas aeruginosa
MDKNLHQPLGGNEMPRFGGIATMMRLPHVQSPAELDALDAAFVGVPLDIGTSLRSGTRFGPREIRAESVMIRPYNMATGAAPFDSLNVADIGDVAINTFNLLEAVRIIEQEYDRILGHGILPLTLGGDHTITLPILRAIKKKHGKVGLVHVDAHADVNDHMFGEKIAHGTTFRRAVEEDLLDCDRVVQIGLRAQGYTAEDFNWSRKQGFRVVQAEECWHKSLEPLMAEVREKVGGGPVYLSFDIDGIDPAWAPGTGTPEIGGLTTIQAMEIIRGCQGLDLIGCDLVEVSPPYDTTGNTSLLGANLLYEMLCVLPGVVRR

SEQ ID NO: 271 - protein, 342 aa, Burkholderia fungorum
MIFRAAFFHCRDTMNTSSFIHPDAGERPQPLSGNAMPRCGGIATMMRLPNVGSAEGFDACFVGVPFDLGTSNRTGARFGPRQIRSESVLLRPYNMATRAAPFDSLRVADLGDVAINPYNLHDSIARIETAYDEILQHDCKPITLGGDHTIALPILRAMHRKHGKVGLIHVDAHADVNDTMMGEKIAHGTPFRRAVEEGLLDCGRVVQIGLRGTGYAAEDFDWCRDQGFEVVQAEACWNQSLAPLMARVRERMGDGPVYITFDIDGIDPAFAPGTGTPEIAGLTVPQALEIIRGSRGLNIVGCDLVEVAPPYDPFGTTALLGANLAFELLCVLPGVEYRASTR

SEQ ID NO: 272 - protein, 318 aa, Pseudomonas aeruginosa
MSNDHPQPLDAAEIPRFAGIPTFMRLPAFTDPAALQVGLIGVPWDGGTTNRAGARHGPREVRNLSSLMRKVHHVSRIAPYDLVRVGDLGDAPVNPIDLLDSLRRIEGFYRQVHAAGTLPLSVGGDHLVTLPIFRALGRERPLGMVHFDAHSDTNDRYFGDNPYTHGTPFRRAIEEGLLDPLRTVQIGIRGSVYSPDDDAFARECGIRVIHMEEFVELGVEATLAEARRVVGDGPTYVSFDVDVLDPAFAPGTGTPEIGGMTSLQAQQLVRGLRGLDLVGADVVEVSPPFDVGGATALVGATMMFELLCLLAESAARSA

SEQ ID NO: 273 - protein, 320 aa, Rhodobacter sphaeroides
MSVLPTDSLSTPRFVGLPSFMRLPMATELQGLDAAIVGLPSDSGAPFRTGARFAPNALRAMSVMLRPINPYRGHINIFEVLRVADAGDATCVPGYEIESLAALERALDAVVEAGAVPFGIGGDHSVSLAGLRAVAKRHGPLGLVHFDSHTDTWDSYFDGKRYSAGTMFRRAIEEGIVDPARSIQVGMRGSLFQPADVSQSVDLGLEVITCDEMFALGLPETARRIAARSAGHPAFLSFDLDFVDPAYAPGVETPECGGPTARETLSLLRSLQGLNLVGCDVVELNPSYDGPGQITALLGATVMAELLAILAEARVRERSR

SEQ ID NO: 274 - protein, 352 aa, Sinorhizobium meliloti
MAWDEQKLNELKAKYGESHGGELFDPTFRKVADKIFTKSGTRLAPYSGIPTFLTAPHMPVDADDPDFGNLQVAMIGVPMDLGVTNRPGSRFGPRALRAIERIGPYNHVLGCAPVHDLRVADIGDVPFRSRYRLEISHEDIEKRISQIVDAGVLPLSVGGDHSITHPILKAVGRKQPVGMIHIDAHCDTGGAFDLTKFHHGGPFRNAVLDGVLDPTRVIQIGIRGSAEYLWEFSYESGMTVIHAEEVTGLGIPAIIEKAKKIVGDGPTYLSFDVDSLDPSFAPGTGTPEVGGLTTREVLELIRGLKGVNLVGGDVVEVAPQYDTTTNTAHAGAQVLFEILSLMVFSPAVAGKG

SEQ ID NO: 275 - protein, 306 aa, Brucella melitensis; identical to SEQ ID NO: 100

SEQ ID NO: 276 - protein, 327 aa, Agrobacterium tumefaciens; identical to SEQ ID NO: 98

SEQ ID NO: 277 - protein, 324 aa, Agrobacterium tumefaciens; identical to SEQ ID NO: 113

SEQ ID NO: 278 - protein, 325 aa, Bradyrhizobium japonicum; identical to SEQ ID NO: 97

SEQ ID NO: 279 - protein, 329 aa, Leishmania mexicana; identical to SEQ ID NO: 103

SEQ ID NO: 280 - protein, 333 aa, Saccharomyces cerevisiae; identical to SEQ ID NO: 104

SEQ ID NO: 281 - protein, 358 aa, Neurospora crassa
MSPSLVDNHAAAYIAAPSSAKAPMIQKPGNTFGMSSPIESKFLSQPRDLGIVAVGFSGGQCKPGVDAAPSALIESGLLTQLREELGYRLHGDDEVHLYTDLVPKEDPPHRNMKNPRAVSNVTKRIAEQVHSHAKEGRLVLTLGGDHSIAIGTIAGSAKAIKERLGREIAVIWVDAHADINTPETSGSGNIHGMPVSFLTGLASEDKEEFFGWLKPDHLLSVKKLVYIGLRDVDPGEKRILRENGIKAFSMHDIDKHGIGRVMEMALGHIGNDTPIHLSFDVDALDPMWAPSTGTPVRGGLTLREGDFICECVHETGSLVAVDLVEVNPTLAAPNDVGAHETVRAGCSLVRSRSRRNVL

SEQ ID NO: 282 - protein, 323 aa, Schizosaccharomyces pombe; identical to SEQ ID NO: 105

SEQ ID NO: 283 - protein, 296 aa, Bacillus subtilis; identical to SEQ ID NO: 107

SEQ ID NO: 284 - protein, 299 aa, Bacillus caldovelox; identical to SEQ ID NO: 108

SEQ ID NO: 285 - protein, 301 aa, Bacillus halodurans; identical to SEQ ID NO: 109

SEQ ID NO: 286 - protein, 298 aa, Bacillus brevis
MNKNMSIVGVPMDLGADRRGVDMGPSAIRYAGVVARLEKMGFNIEDRGDIFVTLPHHFTETENHKYLDEVVEANEKLANVVSDIMTAGRFPLVLGGDHSIALGTIAGVAKHVKNLGVICLDAHGDLNTGATSPSGNIHGMPLAASLGYGHERLTNIGGYTPKVKAENVVIIGARDLDQGERELIKRIGMKVFTMHEIDKLGMARVMDEAIAHVSKNTDGVHLSLDLDGLDPHDAPGVGTPVIGGISYREGHVSLEMLADADILCSAEFVEVNPILDRENMTARVAVALMSSVFGDKLL

SEQ ID NO: 287 - protein, 354 aa, Mus musculus
MFLRSSASRLLHGQIPCVLTRSVHSVAIVGAPFSRGQKKLGVEYGPAAIREAGLLKRLSRLGCHLKDFGDLSFTNVPQDNPYNNLVVYPRSVGLANQELAEVVSRAVSGGYSCVTMGGDHSLAIGTIIGHARHRPDLCVIWVDAHADINTPLTTVSGNIHGQPLSFLIKELQDKVPQLPGFSWIKPCLSPPNIVYIGLRDVEPPEHFILKNYDIQYFSMREIDRLGIQKVMEQTFDRLIGKRQRPIHLSFDIDAFDPKLAPATGTPVVGGLTYREGVYITEEIHNTGLLSALDLVEVNPHLATSEEEAKATARLAVDVIASSFGQTREGGHIVYDHLPTPSSPHESENEECVRI

SEQ ID NO: 288 - protein, 354 aa, Rattus norvegicus
MFLRSSVSRLLHGQIPCALTRSVHSVAVVGAPFSRGQKKKGVEYGPAAIREAGLLKRLSMLGCHIKDFGDLSFTNVPKDDPYNNLVVYPRSVGIANQELAEVVSRAVSGGYSCVTLGGDHSLAIGTISGHARHHPDLCVIWVDAHADINTPLTTVSGNIHGQPLSFLIRELQDKVPQLPGFSWIKPCLSPPNLVYIGLRDVEPAEHFILKSFDIQYFSMRDIDRLGIQKVMEQTFDRLIGKRKRPIHLSFDIDAFDPKLAPATGTPVVGGLTYREGLYITEEIHSTGLLSALDLVEVNPHLATSEEEAKATASLAVDVIASSFGQTREGGHIAYDHLPTPSSPHESEKEECVRI

SEQ ID NO: 289 - protein, 354 aa, Homo sapiens
MSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVPQLPGFSWIKPCISSASIVYIGLRDVDPPEHFILKNYDIQYFSMRDIDRLGIQKVMERTFDLLIGKRQRPIHLSFDIDAFDPTLAPATGTPVVGGLTYREGMYIAEEIHNTGLLSALDLVEVNPQLATSEEEAKTTANLAVDVIASSFGQTREGGHIVYDQLPTPSSPDESENQARVRI

SEQ ID NO: 290 - protein, 347 aa, Danio rerio; identical to SEQ ID NO: 87

SEQ ID NO: 291 - protein, 323 aa, Rattus norvegicus; identical to SEQ ID NO: 90

SEQ ID NO: 292 - protein, 335 aa, Mus musculus
MQQQQPLEPRESMSSKPKSLEIIGAPFSKGQPRGGVEKGPAALRKAGLLEKLKETEYDVRDHGDLAFVDVPNDSSFQIVKNPRSVGKANEELAGVVAEVQKNGRVSVVLGGDHSLAVGSISGHARVHPDLCVIWVDAHTDINTPLTTSSGNLHGQPVSFLLKELKGKFPDVPGFSWVTPCISAKDIVYIGLRDVDPGEHYIIKTLGIKYFSMTEVDKLGIGKVMEETFSYLLGRKKRPIHLSFDVDGLDPAFTPATGTPVLGGLSYREGLYITEEIYKTGLLSGLDIMEVNPTLGKTAEEVKSTVNTAVALTLACFGTQREGNHKPGTDYLKPPK

SEQ ID NO: 293 - protein, 322 aa, Sus scrofa; identical to SEQ ID NO: 94

The invention claimed is:

1. A transgenic plant comprising a heterologous nucleic acid with at least 95% sequence identity to SEQ ID NO:01, operably linked to a plant promoter, wherein said nucleic acid encodes an arginase.

2. The transgenic plant of claim 1, wherein said arginase has the sequence set forth in SEQ ID NO:54 and is encoded by SEQ ID NO:01.

3. A transgenic plant cell comprising a heterologous nucleic acid with at least 95% sequence identity to SEQ ID NO:01, operably linked to a plant promoter, wherein said nucleic acid encodes an arginase.

4. A transgenic plant seed comprising a heterologous nucleic acid with at least 95% sequence identity to SEQ ID NO:01, operably linked to a plant promoter, wherein said nucleic acid encodes an arginase.

5. The transgenic plant of claim 1, wherein said transgenic plant is selected from the group consisting of Solanaceae, Brassicaceae, Poaceae and Coniferales.

6. The transgenic plant cell of claim 3, wherein said transgenic plant cell is selected from the group consisting of Solanaceae, Brassicaceae, Poaceae and Coniferales.

7. The transgenic plant seed of claim 4, wherein said transgenic plant seed is selected from the group consisting of Solanaceae, Brassicaceae, Poaceae and Coniferales.

8. A transgenic plant comprising a heterologous nucleic acid encoding an arginase with at least 95% sequence identity to SEQ ID NO:54, wherein the nucleic acid is operably linked to a plant promoter.

9. The transgenic plant of claim 8, wherein said transgenic plant is selected from the group consisting of Solanaceae, Brassicaceae, Poaceae and Coniferales.

10. A transgenic plant seed comprising a heterologous nucleic acid encoding an arginase with at least 95% sequence identity to SEQ ID NO:54, wherein the nucleic acid is operably linked to a plant promoter.

11. The transgenic plant seed of claim 10, wherein said transgenic plant is selected from the group consisting of Solanaceae, Brassicaceae, Poaceae and Coniferales.

* * * * *